United States Patent
Achiron et al.

(10) Patent No.: US 9,758,831 B2
(45) Date of Patent: Sep. 12, 2017

(54) METHODS OF PREDICTING CLINICAL COURSE AND TREATING MULTIPLE SCLEROSIS

(71) Applicant: Tel HaShomer Medical Research Infrastructure and Services Ltd., Ramat-Gan (IL)

(72) Inventors: Anat Achiron, Tel-Aviv (IL); Michael Gurevich, Rechovot (IL)

(73) Assignee: Tel HaShomer Medical Research Infrastructure and Services Ltd., Ramat-Gan (IL)

( * ) Notice: Subject to any disclaimer, the term of this patent is extended or adjusted under 35 U.S.C. 154(b) by 0 days.

(21) Appl. No.: 14/703,942

(22) Filed: May 5, 2015

(65) Prior Publication Data

US 2015/0315646 A1    Nov. 5, 2015

Related U.S. Application Data

(62) Division of application No. 13/260,573, filed as application No. PCT/IB2010/051344 on Mar. 28, 2010, now abandoned.

(60) Provisional application No. 61/202,703, filed on Mar. 30, 2009.

(51) Int. Cl.
| | | |
|---|---|---|
| C12N 15/11 | (2006.01) | |
| C12N 15/12 | (2006.01) | |
| C12Q 1/68  | (2006.01) | |

(52) U.S. Cl.
CPC ..... *C12Q 1/6883* (2013.01); *C12Q 2600/106* (2013.01); *C12Q 2600/112* (2013.01); *C12Q 2600/136* (2013.01); *C12Q 2600/158* (2013.01); *C12Q 2600/166* (2013.01)

(58) Field of Classification Search
None
See application file for complete search history.

(56) References Cited

U.S. PATENT DOCUMENTS

| | | | | |
|---|---|---|---|---|
| 2004/0143110 A1* | 7/2004 | Krolewski | ............ | C07K 14/47 536/23.2 |
| 2008/0280779 A1* | 11/2008 | Shaughnessy, Jr. | . | C12Q 1/6809 506/10 |
| 2012/0020954 A1 | 1/2012 | Achiron et al. | | |

FOREIGN PATENT DOCUMENTS

| | | |
|---|---|---|
| CA | 2610057 | 5/2008 |
| EP | 0983256 | 3/2000 |
| IL | 199523 | 6/2009 |
| WO | WO 98/52933 | 11/1998 |
| WO | WO 03/081201 | 10/2003 |
| WO | WO 2005/108610 | 11/2005 |
| WO | WO 2007/090280 | 8/2007 |
| WO | WO 2008/081435 | 7/2008 |
| WO | WO 2010/113096 | 10/2010 |

OTHER PUBLICATIONS

Invitation Pursuant to Article 94(3) and Rule 71(1) EPC Dated Dec. 14, 2015 From the European Patent Office Re. Application No. 10713522.0.
Office Action Dated Feb. 11, 2016 From the Israel Patent Office Re. Application No. 215392 and Its Translation Into English.
Communication Pursuant to Article 94(3) EPC Dated Aug. 5, 2014 From the European Patent Office Re. Application No. 10713522.0.
Communication Pursuant to Article 94(3) EPC Dated Jan. 17, 2013 From the European Patent Office Re. Application No. 10713522.0.
Communication Pursuant to Article 94(3) EPC Dated Mar. 17, 2014 From the European Patent Office Re. Application No. 10713522.0.
International Preliminary Report on Patentability Dated Oct. 13, 2011 From the International Bureau of WIPO Re. Application No. PCT/IB2010/051344.
International Search Report and the Written Opinion Dated Jun. 18, 2010 From the International Searching Authority Re. Application No. PCT/IB2010/051344.
Notice of Non-Compliant Amendment Dated Nov. 21, 2011 From the US Patent and Trademark Office Re. U.S. Appl. No. 13/260,573.
Office Action Dated Feb. 18, 2013 From the Israel Patent Office Re. Application No. 215392 and Its Translation Into English.
Office Action Dated May 22, 2014 From the Israel Patent Office Re. Application No. 215392 and Its Translation Into English.
Office Action Dated Oct. 23, 2013 From the Israel Patent Office Re. Application No. 215392 and Its Translation Into English.
Official Action Dated Feb. 12, 2015 From the US Patent and Trademark Office Re. U.S. Appl. No. 13/260,573.
Official Action Dated Oct. 22, 2013 From the US Patent and Trademark Office Re. U.S. Appl. No. 13/260,573.
Official Action Dated Aug. 26, 2014 From the US Patent and Trademark Office Re. U.S. Appl. No. 13/260,573.
Restriction Official Action Dated Jul. 18, 2013 From the US Patent and Trademark Office Re. U.S. Appl. No. 13/260,573.
Achiron et al. Zinc-Ion Binding and Cytokine Activity Regulation Pathways Predicts Outcome in Relapsing-Remitting Multiple Sclerosis, Clinical and Experimental Immunology, XP002480403, 149(2): 235-242, Aug. 1, 2007. p. 238, r-h Col., § 1, 2.
Affymetrix "GeneChip® Human Genome U133 Arrays. The Most Comprehensive Coverage of the Human Genome in Two Flexible Formats: Single-Array Cartridges and Multi-Array Plates", Datasheet Affymetrix, XP007921348, p. 1-8, p. 1-8, Jan. 1, 2003.

(Continued)

*Primary Examiner* — James Martinell

(57) ABSTRACT

Provided are methods and kits for classifying a subject as being more likely to have benign multiple sclerosis (BMS) or as being more likely to have typical relapsing remitting multiple sclerosis (RRMS). Classification of multiple sclerosis disease course is performed by comparing a level of expression of at least one gene involved in the RNA polymerase I pathway in a cell of the subject to a reference expression data of said at least one gene obtained from a cell of at least one subject pre-diagnosed as having BMS and/or from a cell of at least one subject pre-diagnosed as having typical RRMS, thereby classifying the subject as being more likely to have BMS or as being more likely to have typical RRMS. Also provided are methods of diagnosing and treating multiple sclerosis and methods of monitoring treatment efficiency.

4 Claims, 2 Drawing Sheets
(2 of 2 Drawing Sheet(s) Filed in Color)

(56) References Cited

OTHER PUBLICATIONS

Bouwmeester et al. "A Physical and Functional Map of the Human TNF-Alpha/NF-KB Signal Transduction Pathway", Nature Cell Biology, 6(2): 97-105, Feb. 2004.
Cavanaugh et al. "Rrn3 Phosphorylation Is a Regulatory Checkpoint for Ribosome Biogenesis", Journal of Biological Chemistry, 277(30): 27423-27432, 2002.
Costelloe et al. "Long-Term Clinical Relevance of Criteria for Designating Multiple Sclerosis as Benign After 10 Years of Disease", Journal of Neurology, Neurosurgery & Psychiatry, 79(11): 1245-1248, 2008. Abstract.
Gurevich et al. "Prediction of Acute Multiple Sclerosis Relapses by Transcription Levels of Peripheral Blood Cells", BMC Medical Genomics, 2(46): 1-14, Jul. 22, 2009.
Hirschler-Laszkiewicz et al. "Rrn3 Becomes Inactivated in the Process of Ribosomal DNA Transcription", Journal of Biological Chemistry, 278(21): 18953-18959, 2003.
Hong et al. Gene Expression Profiling of Relevant Biomarkers for Treatment Evaluation in Multiple Sclerosis, Journal of Neuroimmunology, XP002566863, 152(1-2): 126-139, Jul. 1, 2004. § [03.2]-[03.3], Fig.4, Tables 5, 6.
Leuenroth et al. "Triptolide-Induced Transcriptional Arrest Is Associated With Changes in Nuclear Substructure", Cancer Research, 68(13):5257-5266, 2008.
Liu et al. "Triptolide, A Component of Chinese Herbal Medicine, Modulates the Functional Phenotype of Dendritic Cells", Transplantation, 84(11): 1517-1526, 2007. Abstract.
Miller et al. "HRRN3 Is Essential in the SL1-Mediated Recruitment of RNA Polymerase I to rRNA Gene Promoters", The EMBO Journal , 20(6): 1373-1382, 2001.
Mootha et al. "Identification of a Gene Causing Human Cytochrome C Oxidase Deficiency by Integrative Genomics", Proc. Natl. Acad. Sci. USA, 100: 605-610, Jan. 21, 2003.
Pittock "Benign Multiple Sclerosis: A Distinct Clinical Entity With Therapeutic Implications", Current Topics in Microbiology and Immunology, 318: 1-17, 2008. Abstract.
Wang "Triptolide Modulates T-Cell Inflammatory Responses and Ameliorates Experimental Autoimmune Encephalomyelitis", Journal of Neuroscience Research, XP002585665, 86(11): 2441-2449, Aug. 2008.
Invitation Pursuant to Article 94(3) and Rule 71(1) EPC Dated Aug. 12, 2016 From the European Patent Office Re. Application No. 10713522.0.
Office Action Dated Aug. 11, 2016 From the Israel Patent Office Re. Application No. 215392 and Its Translation Into English.

* cited by examiner

METHODS OF PREDICTING CLINICAL COURSE AND TREATING MULTIPLE SCLEROSIS

RELATED APPLICATIONS

This application is a division of U.S. patent application Ser. No. 13/260,573 filed on Sep. 27, 2011, which is a National Phase of PCT Patent Application No. PCT/IB2010/051344 having International filing date of Mar. 28, 2010, which claims the benefit of priority of U.S. Provisional Patent Application No. 61/202,703 filed on Mar. 30, 2009. The contents of the above applications are all incorporated herein by reference.

SEQUENCE LISTING STATEMENT

The ASCII file, entitled 62191SequenceListing.txt, created on Sep. 27, 2011, comprising 7,168,844 bytes, submitted concurrently with the filing of this application is incorporated herein by reference.

FIELD AND BACKGROUND OF THE INVENTION

The present invention, in some embodiments thereof, relates to methods of classifying a subject as having benign multiple sclerosis or typical relapsing remitting multiple sclerosis and, more particularly, but not exclusively, to methods of treating multiple sclerosis based on same.

Multiple sclerosis (MS) is the most common demyelinating disease of the central nervous system (CNS) affecting young adults (disease onset between 20 to 40 years of age) and is the third leading cause for disability after trauma and rheumatic diseases, with an estimated annual cost 34,000 USD per patient (total life time cost of 2.2 million USD per patient).

The disease is characterized by destruction of myelin, associated with death of oligodendrocytes and axonal loss. The main pathologic finding in MS is the presence of infiltrating mononuclear cells, predominantly T lymphocytes and macrophages, which surpass the blood brain barrier and induce an active inflammation within the brain and spinal cord. The neurological symptoms that characterize MS include complete or partial vision loss, diplopia, sensory symptoms, motor weakness that can worsen to complete paralysis, bladder dysfunction and cognitive deficits, which eventually may lead to a significant disability. The associated multiple inflammatory foci lead to myelin destruction, plaques of demyelination, gliosis and axonal loss within the brain and spinal cord and are the reasons contribute to the clinical manifestations of neurological disability.

The etiology of MS is not fully understood. The disease develops in genetically predisposed subjects exposed to yet undefined environmental factors and the pathogenesis involves autoimmune mechanisms associated with autoreactive T cells against myelin antigens. It is well established that not one dominant gene determines genetic susceptibility to develop MS, but rather many genes, each with different influence, are involved.

Clinically, in 85% of MS patients the illness is initiated with a relapsing-remitting course (RRMS), and in about 10-15% of MS patients have an a-priori primary progressive course (PPMS) without relapses. RRMS is characterized by inflammatory attacks associated with neurological deficits with periods of remissions between the relapses that vary in time. After a period of 10 years, about 50% of RRMS patients will progress to a secondary progressive MS (SPMS) course, characterized by permanent neurological dysfunction, with or without relapses and progressive disability.

Benign M S (BMS) is a clinical variant of RRMS in which the patients develop low neurological disability if at all after a disease duration of at least 10 years. Accordingly, this group of MS patients do not experience devastating accumulating disability over-time and when these patients are examined neurologically and scored by the Expanded Disability Status Scale (EDSS) they receive a score that is equal to or lower than 3.0. This low EDSS score signifies mild disability and when this low disability occurs more than 10 years after disease onset, the course of MS is defined as benign (Pittock S J and Rodriguez M, 2008; Costelloe, L., et al., 2008). Prediction of patients that will have BMS is currently impossible and the definition of these patients is retrospective. The molecular events accountable for the BMS variant of disease are not understood.

Diterpenoid triepoxide Triptolide (TPT), isolated from the Chinese herb *Tripterygium wilfordii* (Leuenroth S J and Crews C M. Triptolide-induced transcriptional arrest is associated with changes in nuclear substructure. Cancer Res. 2008; 68:5257-5266) has various anti-inflammatory effects (Liu Y, et al. Triptolide, a component of Chinese herbal medicine, modulates the functional phenotype of dendritic cells. Transplantation. 2007; 84:1517-1526), it modulates T-cell inflammatory responses and ameliorates Experimental Autoimmune Encephalomyelitis (Wang Y, et al. Triptolide modulates T-cell inflammatory responses and ameliorates experimental autoimmune encephalomyelitis. J Neurosci Res. 2008; 86:2441-2449). Derivatives of TPT were suggested for treating autoimmune diseases (EP 0983256, PCT/US1998/008562; WO9852933A1).

Cycloheximide, inhibits the phosphorylation of RRN3 and causes its dissociation from RNA polymerase I. RRN3 interacts with the rpa43 subunit of RNA polymerase I, and treatment with cycloheximide inhibits the formation of a RRN3/rpa43 complex in vivo (Alice H. Cavanaugh, et al., 2002. Rrn3 Phosphorylation is a regulatory checkpoint for ribosome biogenesis J. Biol. Chem., 2002; 277: 27423-27432).

PCT Application No. PCT/IL2007/32856 discloses methods and kits for predicting prognosis of multiple sclerosis.

PCT Application No. PCT/IL2007/001617 discloses methods and kits for predicting the prognosis of a subject diagnosed with multiple sclerosis and methods of selecting a treatment regimen of a subject diagnosed with multiple sclerosis.

Achiron A, et al., 2007 (Clinical and Experimental Immunology, 149: 235-242) describe genes of the zinc-ion binding and cytokine activity regulation pathways which predict outcome in relapsing—remitting multiple sclerosis.

Additional background art includes PCT Pub. No. WO03081201A2.

SUMMARY OF THE INVENTION

According to an aspect of some embodiments of the present invention there is provided a method of classifying a subject as being more likely to have benign multiple sclerosis (BMS) or as being more likely to have typical relapsing remitting multiple sclerosis (RRMS), the method comprising comparing a level of expression of at least one gene involved in the RNA polymerase I pathway in a cell of the subject to a reference expression data of the at least one gene obtained from a cell of at least one subject pre-diagnosed as having BMS and/or from a cell of at least one subject pre-diagnosed as having typical RRMS, thereby classifying the subject as being more likely to have BMS or as being more likely to have typical RRMS.

According to an aspect of some embodiments of the present invention there is provided a method of diagnosing a subject pre-diagnosed with multiple sclerosis (MS) as having benign multiple sclerosis (BMS) or typical relapsing remitting multiple sclerosis (RRMS), the method comprising:

(a) classifying the subject as being more likely to have BMS or as being more likely to have typical RRMS according to the method of the present invention, (i) wherein when the subject is classified as being more likely to have the BMS then the subject is diagnosed as having BMS;

(ii) wherein when the subject is classified as being more likely to have the typical RRMS, then the subject is diagnosed as having typical RRMS; and (c) informing the subject of the diagnosis, thereby diagnosing the subject pre-diagnosed with the MS as having the BMS or the typical RRMS.

According to an aspect of some embodiments of the present invention there is provided a method of monitoring an efficiency of an anti multiple sclerosis (MS) drug in treating a subject diagnosed with a typical relapsing remitting multiple sclerosis (RRMS) course, the method comprising:

(a) treating the subject with the anti MS drug; and (b) comparing a level of expression of least one gene involved in the RNA polymerase I pathway in a cell of the subject following the treating with the anti MS drug to a level of expression of the at least one gene in a cell of the subject prior to the treating the subject with the anti MS drug, (i) wherein a decrease above a predetermined threshold in the level of expression of the at least one gene following the treating with the anti MS drug relative to the level of expression of the at least one gene prior to the treating with the anti MS drug indicates that the anti MS drug is efficient for treating the subject;

(ii) wherein an increase above a predetermined threshold in the level of expression of the at least one gene following the treating with the anti MS drug relative to the level of expression of the at least one gene prior to the treating with the anti MS drug indicates that the anti MS drug is not efficient for treating the subject; or (iii) wherein when a level of expression of the at least one gene following the treating with the anti MS drug is identical or changed below a predetermined threshold as compared to prior to the treating with the anti MS drug then the treatment is not efficient for treating the subject.

thereby monitoring the efficiency of the anti multiple sclerosis (MS) drug in treating the subject diagnosed with the typical RRMS course.

According to an aspect of some embodiments of the present invention there is provided an in vitro method of predicting an efficiency of an anti multiple sclerosis (MS) drug for treatment of a subject diagnosed with a typical relapsing remitting multiple sclerosis (RRMS), the method comprising:

(a) contacting cells of the subject with a therapeutically effective amount of the anti MS drug; and (b) comparing a level of expression in the cells of at least one gene involved in the RNA polymerase I pathway following the contacting with the anti MS drug to a level of expression of the at least one gene in the cells prior to the contacting with the anti MS drug, (i) wherein a decrease above a predetermined threshold in the level of expression of the at least one gene following the contacting with the anti MS drug relative to the level of expression of the at least one gene prior to the contacting with the anti MS drug indicates that the treatment is efficient for treating the subject;

(ii) wherein an increase above a predetermined threshold in the level of expression of the at least one gene following the contacting with the anti MS drug relative to the level of expression of the at least one gene prior to the contacting with the anti MS drug indicates that the treatment is not efficient for treating the subject; or (iii) wherein when a level of expression of the at least one gene following the contacting with the anti MS drug is identical or changed below a predetermined threshold as compared to prior to the contacting with the anti MS drug then the treatment is not efficient for treating the subject.

thereby predicting the efficiency of the anti MS drug for treatment of the subject diagnosed with the typical RRMS.

According to an aspect of some embodiments of the present invention there is provided a method of treating a subject diagnosed with multiple sclerosis, the method comprising (a) classifying the subject as being more likely to have BMS or typical RRMS according to the method of the present invention, (b) selecting a treatment regimen based on classification results of step (a); thereby treating the subject diagnosed with multiple sclerosis.

According to an aspect of some embodiments of the present invention there is provided a method of treating a subject diagnosed with multiple sclerosis, the method comprising:

(a) diagnosing a typical relapsing remitting multiple sclerosis (RRMS) according to the method of the present invention, (b) administering to the subject a therapeutically effective amount of diterpenoid triepoxide Triptolide (TPT) or a derivative thereof, thereby treating the subject.

According to an aspect of some embodiments of the present invention there is provided a probeset comprising a plurality of oligonucleotides and no more than 50 oligonucleotides, wherein an oligonucleotide of the plurality of oligonucleotides specifically recognizes a polynucleotide of at least one gene involved in the RNA polymerase pathway.

According to an aspect of some embodiments of the present invention there is provided a kit for classifying a disease course in a subject diagnosed with multiple sclerosis (MS), comprising the probeset of the present invention.

According to an aspect of some embodiments of the present invention there is provided a method of selecting a drug for treating a typical relapsing remitting multiple sclerosis (RRMS) in a subject, the method comprising:

contacting cells of a subject classified as having a typical RRMS with a plurality of drug molecules, identifying at least one drug molecule which downregulates a level of expression of at least one gene involved in the RNA polymerase I pathway, the at least one drug molecule is suitable for treating the typical RRMS in the subject, thereby selecting the drug for treating the typical RRMS in the subject.

According to some embodiments of the invention, a decrease above a predetermined threshold in the level of expression of the at least one gene in the cell of the subject relative to the reference expression data of the at least one gene obtained from the at least one subject having the typical RRMS classifies the subject as being more likely to have the BMS.

According to some embodiments of the invention, an increase above a predetermined threshold in the level of expression of the at least one gene in the cell of the subject relative to the reference expression data of the at least one gene obtained from the at least one subject having the BMS classifies the subject as being more likely to have the typical RRMS.

According to some embodiments of the invention, a level of expression of the at least one gene in the cell of the subject is identical or changed below a predetermined threshold as compared to the reference expression data of the at least one gene obtained from the at least one subject having the BMS, then the subject is classified as being more likely to have the BMS.

According to some embodiments of the invention, a level of expression of the at least one gene in the cell of the subject is identical or changed below a predetermined threshold as compared to the reference expression data of the at least one gene obtained from the at least one subject having the typical RRMS, then the subject is classified as being more likely to have the typical RRMS.

According to some embodiments of the invention, when the subject being more likely to have typical RRMS then the treatment regimen comprises administering to the subject an agent which downregulates the level of expression of the at least one gene involved in the RNA polymerase I pathway.

According to some embodiments of the invention, the at least one gene involved in the RNA polymerase 1 pathway is selected from the group consisting of POLR1D, LRPPRC, RRN3 and NCL.

According to some embodiments of the invention, the at least one gene involved in the RNA polymerase 1 pathway comprises the POLR1D, LRPPRC, RRN3 and NCL genes.

According to some embodiments of the invention, the agent is selected from the group consisting of an siRNA, an antisense, an antibody and a small molecule.

According to some embodiments of the invention, the small molecule is Cycloheximide According to some embodiments of the invention, the at least one gene is RRN3, and whereas the downregulating is effected using diterpenoid triepoxide Triptolide (TPT) or a derivative thereof.

According to some embodiments of the invention, the at least one gene is RRN3, and whereas the downregulating is effected using Cycloheximide According to some embodiments of the invention, the kit further comprising a positive control for an expression level of the at least one gene involved in the RNA polymerase pathway.

According to some embodiments of the invention, each of the plurality of oligonucleotides is bound to a solid support.

According to some embodiments of the invention, the plurality of oligonucleotides are bound to the solid support in an addressable location.

According to some embodiments of the invention, the level of expression is determined using an RNA detection method.

According to some embodiments of the invention, the level of expression is determined using a protein detection method.

According to some embodiments of the invention, the cell is a blood cell.

According to some embodiments of the invention, the method further comprising administering to the subject a therapeutically effective amount of an anti MS agent.

According to some embodiments of the invention, the anti-MS agent is selected from the group consisting of Diterpenoid triepoxide Triptolide (TPT), Adderall, Ambien, Avonex, Baclofen, Beta interferon, Betaseron, Celexa, Clonazepam, Copaxone, Corticosteroids, Cymbalta, Cytoxan, Dexamethasone, Effexor, Elavil, Gabapentin, Hydrocodone, Lexapro, Lyrica, Mitoxantrone, Naltrexone, Neurontin, Novantrone, Prednisone, Provigil, Rebif, Solumedrol, Symmetrel, Topamax, Tysabri, Wellbutrin, Xanax, Zanaflex, Zoloft, fingolimod, laquinimod, Mylinax (cladribine), teriflunomide, BG-12 (Biogen Idec's), firategrast (GSK/Mitsubishi Tanabe Pharma), ibudilast (MediciNova's), and CDP323 (Biogen/UCB).

According to an aspect of some embodiments of the present invention there is provided a method of predicting a benign multiple sclerosis course in a subject diagnosed with multiple sclerosis, the method comprising: (a) determining in a biological sample of the subject a level of expression of at least one polynucleotide selected from the group consisting of C22orf8, TLK1, HNRPH1, PLXDC1, TLK1, PKN2, ALS2CR8, FLJ12547, ZNF238, PDPR, NT5E, PASK, HPGD, IL6ST, JARID1A, PASK, LEF1, FLJ10246, MTUS1, FLJ14011, VSIG4, MARCH-VI, FLJ10613, EWSR1, ATP8A1, SLC4A7, FLJ21127, HNRPH1, ABLIM1, ITGA6, ADCY9, CROCC, SH3YL1, SMA4, SPTBN1, DPEP3, PDE3B, AF5Q31, NRCAM, DOCK9, IPW, FLJ20152, SIRPB2, GALNT4, CD28, TXK, ETS1, DGCR5, ZNF192, TCF7, CAMK4, SIM2, MGEA5, TGFBR2, RET, MAPK8IP3, RRN3, DKFZp547H025, FBXW11, ZNF423, DLG1, MGC17330, CD164L1, REPS1, ACHE, ITGB1BP2, LOC94431, LTK, RUNX1, EVER1, KIAA2010, CEACAM7, STX16, SLC4A5, CRTAP, RECQL5, MAGEF1, VIPR1, FLJ10979, TTC3, CRSP2, BAZ2A, GTF2I, MGC50853, KIAA0508, BPHL, LTBP4, FN3KRP, SCARB1, MGC17330, HYAL4, DGKA, FLJ11196, DHRS6, EPHB4, IDI2/GTPBP4, SNTG2, SLC7A6, PMS2L2, KIAA0436, TOSO, THRAP3, T3JAM, LOC283232, LOC92482, PTER, ATM, NUCB2, PIK3R2, MGC1136, CD59, JARID1A, FLJ39616, ABLIM1, PBP, MAPK8IP3, FTS, LHX5, TNFRSF7, MYC, PBXIP1, DATF1, HTF9C, PUS1, KIAA0924, C6orf4, KIAA0372, WDR42A, CRYZL1, TERE1, LTBP4, TTC3, NFATC1, POM121/LOC340318, TOSO, LOC348926/MGC16279/ SB153/FLJ10661, SPOCK2, KIAA0515, SLC37A4, CD44, SMARCA2, SPTBN1, C6orf130, TTC3, DLG1, SLC35E2, MCCC1, PMS2L11, RCN3, STX16, FLJ20618, STAT5B, SMARCA2, SATB1, POLR1D, ASXL1, REV1L, PMS2L2/ PMS2L5, FLJ12355, CCNB1IP1, FLJ12270, KIAA0692, MCM7, GPSN2, STX16, MMS19L, GTF2I/GTF2IP1, AKAP7, ZNF444, SLC35A3, MGEA5, RUTBC3, C20orf36, RAD17, ALG12, LOC112869, C6orf48, CUTC, LGTN, DEF6, WAC, HNRPH3, NS, KIAA0892, LRPPRC, HMG20A, DDX42, TINP1, ZDHHC17, C19orf2, EIF4B, LOC376745, DKFZP434C171, TH1L, C19orf13, RPL22, PHF15, EWSR1, EIF4B, FAM48A, YT521, NEK9, EIF3S7, RPS6, RPL35A, EEF2, RPL3, RPS6, UBA52, RPL6, RPS6, RPL13, AL353949, AL580863, AF052160, AW128846, AW974481, N92920, BG178274, AW303460, BF057458, AL050035, M59917, AK025422, AI693985, AU158442, AK021460, AL023773, NM_003790, AC005011, M90355, AL353580, U38964, D50683 and BE967207, wherein downregulation below a predetermined threshold in the level of expression relative to a level of expression of the at least one polynucleotide in a biological sample of a subject diagnosed with typical relapsing-remitting multiple sclerosis (RRMS) is indicative of the prediction of the benign multiple sclerosis course of the subject; (b) informing the subject of the prediction of the benign multiple sclerosis course; thereby predicting the benign multiple sclerosis course in the subject diagnosed with the multiple sclerosis.

According to an aspect of some embodiments of the present invention there is provided a method of predicting a benign multiple sclerosis course in a subject diagnosed with multiple sclerosis, the method comprising: (a) determining in a biological sample of the subject a level of expression of at least one polynucleotide selected from the group consisting of YWHAB, ATP6V1E1, UBB, MRLC2/MRCL3, UQCR, MRLC2, RTN4, UBE2A, RTN4, WDR1, PSMA6, C14orf123, PP1201, TBK1, CAST, CAST, RSN, PSME1, SDF2, GSTO1, CAST, DNCL1, SQRDL, ADIPOR2, ICMT, NDUFA6, NDUFA6, COX17, HIF1AN, FLJ20257, TBPL1, RAPGEF2, CRSP8, APOL1, PAOX, CNDP2, ETFA, DPP3, KPNA1, MGC3036, TUBB2, PDCL, CCL5, CDS2, RAP1GDS1, ATP6V1D, OBRGRP/LEPR, SF4, GCLC, MGST3, BICD2, BRF1, CHST12, EXOSC7, TOR1B, ZFP95, ILK, UNC13A, MTHFD2, CASP10, FLJ45850, CMRF-35H, ARF3, NDOR1, DUSP10, AP1M2, VRK2, GSN, PTRF, RBM19, RABGAP1L, ATP5S, STOM, TFPI2, SLCO3A1, PTPN12, CSF1, SIGLEC6, KIRREL, OBRGRP, TP53AP1, SUHW1, NUP98, IL15RA, MICB, CMRF-35H, SPHK1, TNFRSF6, FLJ1301, LRP5, STOM, EPHA2, SRC, FLJ11301, PSTPIP2, EBP, MCPH1, PTPRF, LIMK2, FSTL4, CBR1, MGC2654, MYCT1, NOL3, MITF, ATP10B, FBXO31, TBX21, LSS, SLC17A3, MNAB, CHPPR, GIF, VAMPS, ABCG2, KIF1B, LOH11CR2A, NID2, RBBP8, ETV7, CTSL, RUFY1, RSU1, PARD3, APOB, ACOX3, DAB2, LDLR, TJP2, GNAS, PARD3, NCKAP1, TAP2, HDGFRP3, LDLR, PIK3R3, HTR2B, GAS2L1, FER1L3, C3orf14, TP53TG3, LEPR, CLIC5, PDE4DIP, ATP9A, ITGB1BP1, INDO, SELP, FHL2, FER1L3, EGF, SIAT8A, HDGFRP3, LRAP, VWF, FLJ10134, IMP-3, DMN, MCTP1, FSTL1, CTNNAL1, RAB27B, THBS1, PROS1, MMRN1, CTTN, AL078596, AI148659, U00956 and M29383, wherein upregulation above a predetermined threshold in the level of expression relative to a level of expression of the at least one polynucleotide in a biological sample of a subject diagnosed with typical relapsing-remitting multiple sclerosis (RRMS) is indicative of the prediction of the benign multiple sclerosis course of the subject; (b) informing the subject of the prediction of the benign multiple sclerosis course; thereby predicting the benign multiple sclerosis course in the subject diagnosed with the multiple sclerosis.

According to an aspect of some embodiments of the present invention there is provided a method of monitoring treatment with an anti MS drug in a subject in need thereof, the method comprising: (a) treating the subject with the anti MS drug; and (b) determining in a biological sample of the subject a level of expression of at least one polynucleotide selected from the group consisting of YWHAB, ATP6V1E1, UBB, MRLC2/MRCL3, UQCR, MRLC2, RTN4, UBE2A, RTN4, WDR1, PSMA6, C14orf123, PP1201, TBK1, CAST, CAST, RSN, PSME1, SDF2, GSTO1, CAST, DNCL1, SQRDL, ADIPOR2, ICMT, NDUFA6, NDUFA6, COX17, HIF1AN, FLJ20257, TBPL1, RAPGEF2, CRSP8, APOL1, PAOX, CNDP2, ETFA, DPP3, KPNA1, MGC3036, TUBB2, PDCL, CCL5, CDS2, RAP1GDS1, ATP6V1D, OBRGRP/LEPR, SF4, GCLC, MGST3, BICD2, BRF1, CHST12, EXOSC7, TOR1B, ZFP95, ILK, UNC13A, MTHFD2, CASP10, FLJ45850, CMRF-35H, ARF3, NDOR1, DUSP10, AP1M2, VRK2, GSN, PTRF, RBM19, RABGAP1L, ATP5S, STOM, TFPI2, SLCO3A1, PTPN12, CSF1, SIGLEC6, KIRREL, OBRGRP, TP53AP1, SUHW1, NUP98, IL15RA, MICB, CMRF-35H, SPHK1, TNFRSF6, FLJ11301, LRP5, STOM, EPHA2, SRC, FLJ11301, PSTPIP2, EBP, MCPH1, PTPRF, LIMK2, FSTL4, CBR1, MGC2654, MYCT1, NOL3, MITF, ATP10B, FBXO31, TBX21, LSS, SLC17A3, MNAB, CHPPR, GIF, VAMPS, ABCG2, KIF1B, LOH11CR2A, NID2, RBBP8, ETV7, CTSL, RUFY1, RSU1, PARD3, APOB, ACOX3, DAB2, LDLR, TJP2, GNAS, PARD3, NCKAP1, TAP2, HDGFRP3, LDLR, PIK3R3, HTR2B, GAS2L1, FER1L3, C3orf14, TP53TG3, LEPR, CLIC5, PDE4DIP, ATP9A, ITGB1BP1, INDO, SELP, FHL2, FER1L3, EGF, SIAT8A, HDGFRP3, LRAP, VWF, FLJ10134, IMP-3, DMN, MCTP1, FSTL1, CTNNAL1, RAB27B, THBS1, PROS1, MMRN1, CTTN, AL078596, AI148659, U00956 and M29383, wherein an upregulation above a predetermined threshold in the level of expression relative to a level of expression of the at least one polynucleotide in a biological sample of a subject diagnosed with typical relapsing-remitting multiple sclerosis (RRMS) is indicative of treatment efficacy.

According to some embodiments of the invention, step (b) is effected also prior to step (a) and wherein the upregulation is with respect to a level of the at least one polynucleotide prior to the treating.

According to an aspect of some embodiments of the present invention there is provided a method of monitoring treatment with an anti MS drug in a subject in need thereof, the method comprising: (a) treating the subject with the anti MS drug; and (b) determining in a biological sample of the subject a level of expression of at least one polynucleotide selected from the group consisting of C22orf8, TLK1, HNRPH1, PLXDC1, TLK1, PKN2, ALS2CR8, FLJ12547, ZNF238, PDPR, NT5E, PASK, HPGD, IL6ST, JARID1A, PASK, LEF1, FLJ10246, MTUS1, FLJ14011, VSIG4, MARCH-VI, FLJ10613, EWSR1, ATP8A1, SLC4A7, FLJ21127, HNRPH1, ABLIM1, ITGA6, ADCY9, CROCC, SH3YL1, SMA4, SPTBN1, DPEP3, PDE3B, AF5Q31, NRCAM, DOCK9, IPW, FLJ20152, SIRPB2, GALNT4, CD28, TXK, ETS1, DGCR5, ZNF192, TCF7, CAMK4, SIM2, MGEA5, TGFBR2, RET, MAPK8IP3, RRN3, DKFZp547H025, FBXW11, ZNF423, DLG1, MGC17330, CD164L1, REPS1, ACHE, ITGB1BP2, LOC94431, LTK, RUNX1, EVER1, KIAA2010, CEACAM7, STX16, SLC4A5, CRTAP, RECQL5, MAGEF1, VIPR1, FLJ10979, TTC3, CRSP2, BAZ2A, GTF2I, MGC50853, KIAA0508, BPHL, LTBP4, FN3KRP, SCARB1, MGC17330, HYAL4, DGKA, FLJ11196, DHRS6, EPHB4, IDI2/GTPBP4, SNTG2, SLC7A6, PMS2L2, KIAA0436, TOSO, THRAP3, T3JAM, LOC283232, LOC92482, PTER, ATM, NUCB2, PIK3R2, MGC1136, CD59, JARID1A, FLJ39616, ABLIM1, PBP, MAPK8IP3, FTS, LHX5, TNFRSF7, MYC, PBXIP1, DATF1, HTF9C, PUS1, KIAA0924, C6orf4, KIAA0372, WDR42A, CRYZL1, TERE1, LTBP4, TTC3, NFATC1, POM121/LOC340318, TOSO, LOC348926/MGC16279/SB153/FLJ10661, SPOCK2, KIAA0515, SLC37A4, CD44, SMARCA2, SPTBN1, C6orf130, TTC3, DLG1, SLC35E2, MCCC1, PMS2L11, RCN3, STX16, FLJ20618, STAT5B, SMARCA2, SATB1, POLR1D, ASXL1, REV1L, PMS2L2/PMS2L5, FLJ12355, CCNB1IP1, FLJ12270, KIAA0692, MCM7, GPSN2, STX16, MMS19L, GTF2I/GTF2IP1, AKAP7, ZNF444, SLC35A3, MGEA5, RUTBC3, C20orf36, RAD17, ALG12, LOC112869, C6orf48, CUTC, LGTN, DEF6, WAC, HNRPH3, NS, KIAA0892, LRPPRC, HMG20A, DDX42, TINP1, ZDHHC17, C19orf2, EIF4B, LOC376745, DKFZP434C171, TH1L, C19orf13, RPL22, PHF15, EWSR1, EIF4B, FAM48A, YT521, NEK9, EIF3S7, RPS6, RPL35A, EEF2, RPL3, RPS6, UBA52, RPL6, RPS6, RPL13, AL353949, AL580863, AF052160, AW128846, AW974481, N92920, BG178274, AW303460, BF057458, AL050035, M59917, AK025422, AI693985, AU158442, AK021460, AL023773, NM_003790, AC005011, M90355, AL353580, U38964, D50683 and BE967207, wherein downregulation below a predetermined threshold in the level of expression relative to a level of expression of the at least one polynucleotide in a biological sample of a subject diagnosed with typical relapsing-remitting multiple sclerosis (RRMS) is indicative of treatment efficacy.

According to some embodiments of the invention, step (b) is effected also prior to step (a) and wherein the downregulation is with respect to a level of the at least one polynucleotide prior to the treating.

According to an aspect of some embodiments of the present invention there is provided a method of predicting a typical relapsing-remitting multiple sclerosis (RRMS) course in a subject diagnosed with multiple sclerosis, the method comprising: (a) determining in a biological sample of the subject a level of expression of at least one polynucleotide selected from the group consisting of YWHAB, ATP6V1E1, UBB, MRLC2/MRCL3, UQCR, MRLC2, RTN4, UBE2A, RTN4, WDR1, PSMA6, C14orf123, PP1201, TBK1, CAST, CAST, RSN, PSME1, SDF2, GSTO1, CAST, DNCL1, SQRDL, ADIPOR2, ICMT, NDUFA6, NDUFA6, COX17, HIF1AN, FLJ20257, TBPL1, RAPGEF2, CRSP8, APOL1, PAOX, CNDP2, ETFA, DPP3, KPNA1, MGC3036, TUBB2, PDCL, CCL5, CDS2, RAP1GDS1, ATP6V1D, OBRGRP/LEPR, SF4, GCLC, MGST3, BICD2, BRF1, CHST12, EXOSC7, TOR1B, ZFP95, ILK, UNC13A, MTHFD2, CASP10, FLJ45850, CMRF-35H, ARF3, NDOR1, DUSP10, AP1M2, VRK2, GSN, PTRF, RBM19, RABGAP1L, ATP5S, STOM, TFPI2, SLCO3A1, PTPN12, CSF1, SIGLEC6, KIRREL, OBRGRP, TP53AP1, SUHW1, NUP98, IL15RA, MICB, CMRF-35H, SPHK1, TNFRSF6, FLJ11301, LRP5, STOM, EPHA2, SRC, FLJ11301, PSTPIP2, EBP, MCPH1, PTPRF, LIMK2, FSTL4, CBR1, MGC2654, MYCT1, NOL3, MITF, ATP10B, FBXO31, TBX21, LSS, SLC17A3, MNAB, CHPPR, GIF, VAMPS, ABCG2, KIF1B, LOH11CR2A, NID2, RBBP8, ETV7, CTSL, RUFY1, RSU1, PARD3, APOB, ACOX3, DAB2, LDLR, TJP2, GNAS, PARD3, NCKAP1, TAP2, HDGFRP3, LDLR, PIK3R3, HTR2B, GAS2L1, FER1L3, C3orf14, TP53TG3, LEPR, CLIC5, PDE4DIP, ATP9A, ITGB1BP1, INDO, SELP, FHL2, FER1L3, EGF, SIAT8A, HDGFRP3, LRAP, VWF, FLJ10134, IMP-3, DMN, MCTP1, FSTL1, CTNNAL1, RAB27B, THBS1, PROS1, MMRN1, CTTN, AL078596, AI148659, U00956 and M29383, wherein downregulation below a predetermined threshold in the level of expression relative to a level of expression of the at least one polynucleotide in a biological sample of a subject diagnosed with benign multiple sclerosis (BMS) is indicative of the prediction of the relapsing-remitting multiple sclerosis course of the subject; (b) informing the subject of the prediction of the relapsing-remitting multiple sclerosis course; thereby predicting the relapsing-remitting multiple sclerosis course in the subject diagnosed with the multiple sclerosis.

According to an aspect of some embodiments of the present invention there is provided a method of predicting a typical relapsing-remitting multiple sclerosis (RRMS) course in a subject diagnosed with multiple sclerosis, the method comprising: (a) determining in a biological sample of the subject a level of expression of at least one polynucleotide selected from the group consisting of C22orf8, TLK1, HNRPH1, PLXDC1, TLK1, PKN2, ALS2CR8, FLJ12547, ZNF238, PDPR, NT5E, PASK, HPGD, IL6ST, JARID1A, PASK, LEF1, FLJ10246, MTUS1, FLJ14011, VSIG4, MARCH-VI, FLJ10613, EWSR1, ATP8A1, SLC4A7, FLJ21127, HNRPH1, ABLIM1, ITGA6, ADCY9, CROCC, SH3YL1, SMA4, SPTBN1, DPEP3, PDE3B, AF5Q31, NRCAM, DOCK9, IPW, FLJ20152, SIRPB2, GALNT4, CD28, TXK, ETS1, DGCR5, ZNF192, TCF7, CAMK4, SIM2, MGEA5, TGFBR2, RET, MAPK8IP3, RRN3, DKFZp547H025, FBXW11, ZNF423, DLG1, MGC17330, CD164L1, REPS1, ACHE, ITGB1BP2, LOC94431, LTK, RUNX1, EVER1, KIAA2010, CEACAM7, STX16, SLC4A5, CRTAP, RECQL5, MAGEF1, VIPR1, FLJ10979, TTC3, CRSP2, BAZ2A, GTF2I, MGC50853, KIAA0508, BPHL, LTBP4, FN3KRP, SCARB1, MGC17330, HYAL4, DGKA, FLJ11196, DHRS6, EPHB4, IDI2/GTPBP4, SNTG2, SLC7A6, PMS2L2, KIAA0436, TOSO, THRAP3, T3JAM, LOC283232, LOC92482, PTER, ATM, NUCB2, PIK3R2, MGC1136, CD59, JARID1A, FLJ39616, ABLIM1, PBP, MAPK8IP3, FTS, LHX5, TNFRSF7, MYC, PBXIP1, DATF1, HTF9C, PUS1, KIAA0924, C6orf4, KIAA0372, WDR42A, CRYZL1, TERE1, LTBP4, TTC3, NFATC1, POM121/LOC340318, TOSO, LOC348926/MGC16279/SB153/FLJ10661, SPOCK2, KIAA0515, SLC37A4, CD44, SMARCA2, SPTBN1, C6orf130, TTC3, DLG1, SLC35E2, MCCC1, PMS2L11, RCN3, STX16, FLJ20618, STAT5B, SMARCA2, SATB1, POLR1D, ASXL1, REV1L, PMS2L2/PMS2L5, FLJ12355, CCNB1IP1, FLJ12270, KIAA0692, MCM7, GPSN2, STX16, MMS19L, GTF2I/GTF2IP1, AKAP7, ZNF444, SLC35A3, MGEA5, RUTBC3, C20orf36, RAD17, ALG12, LOC112869, C6orf48, CUTC, LGTN, DEF6, WAC, HNRPH3, NS, KIAA0892, LRPPRC, HMG20A, DDX42, TINP1, ZDHHC17, C19orf2, EIF4B, LOC376745, DKFZP434C171, TH1L, C19orf13, RPL22, PHF15, EWSR1, EIF4B, FAM48A, YT521, NEK9, EIF3S7, RPS6, RPL35A, EEF2, RPL3, RPS6, UBA52, RPL6, RPS6, RPL13, AL353949, AL580863, AF052160, AW128846, AW974481, N92920, BG178274, AW303460, BF057458, AL050035, M59917, AK025422, AI693985, AU158442, AK021460, AL023773, NM_003790, AC005011, M90355, AL353580, U38964, D50683 and BE967207, wherein upregulation above a predetermined threshold in the level of expression relative to a level of expression of the at least one polynucleotide in a biological sample of a subject diagnosed with benign multiple sclerosis (BMS) is indicative of the prediction of the relapsing-remitting multiple sclerosis course of the subject; (b) informing the subject of the prediction of the relapsing-remitting multiple sclerosis course; thereby predicting the relapsing-remitting multiple sclerosis course in the subject diagnosed with the multiple sclerosis.

According to an aspect of some embodiments of the present invention there is provided a method of treating a subject diagnosed with multiple sclerosis, the method comprising: (a) determining if the subject is predicted to have a relapsing-remitting multiple sclerosis course according to the method of the invention, (b) selecting a treatment regimen based on the prediction of the relapsing-remitting multiple sclerosis course; thereby treating the subject diagnosed with multiple sclerosis.

According to an aspect of some embodiments of the present invention there is provided a method of treating a subject diagnosed with multiple sclerosis, the method comprising: (a) determining in a biological sample of the subject a level of expression of RRN3, wherein upregulation above a predetermined threshold in the level of expression relative to a level of expression of the RRN3 in a biological sample of a subject diagnosed with benign multiple sclerosis (BMS) is indicative of the prediction of the relapsing-remitting multiple sclerosis course of the subject; (b) administering to the subject a therapeutically effective amount of diterpenoid triepoxide Triptolide (TPT) or a derivative thereof, thereby treating the subject.

According to an aspect of some embodiments of the present invention there is provided a method of treating a subject diagnosed with multiple sclerosis, the method comprising: administering to the subject an agent which downregulates the expression level and/or activity of at least one polynucleotide or polypeptide of the RNA polymerase 1 pathway, with the proviso that the agent is not diterpenoid triepoxide Triptolide (TPT), thereby treating the subject.

According to an aspect of some embodiments of the present invention there is provided a probeset comprising a plurality of oligonucleotides and no more than 500 oligonucleotides, the plurality of oligonucleotides specifically recognizing the polynucleotides of C22orf8, TLK1, HNRPH1, PLXDC1, TLK1, PKN2, ALS2CR8, FLJ12547, ZNF238, PDPR, NT5E, PASK, HPGD, IL6ST, JARID1A, PASK, LEF1, FLJ10246, MTUS1, FLJ14011, VSIG4, MARCH-VI, FLJ10613, EWSR1, ATP8A1, SLC4A7, FLJ21127, HNRPH1, ABLIM1, ITGA6, ADCY9, CROCC, SH3YL1, SMA4, SPTBN1, DPEP3, PDE3B, AF5Q31, NRCAM, DOCK9, IPW, FLJ20152, SIRPB2, GALNT4, CD28, TXK, ETS1, DGCR5, ZNF192, TCF7, CAMK4, SIM2, MGEA5, TGFBR2, RET, MAPK8IP3, RRN3, DKFZp547H025, FBXW11, ZNF423, DLG1, MGC17330, CD164L1, REPS1, ACHE, ITGB1BP2, LOC94431, LTK, RUNX1, EVER1, KIAA2010, CEACAM7, STX16, SLC4A5, CRTAP, RECQL5, MAGEF1, VIPR1, FLJ10979, TTC3, CRSP2, BAZ2A, GTF2I, MGC50853, KIAA0508, BPHL, LTBP4, FN3KRP, SCARB1, MGC17330, HYAL4, DGKA, FLJ11196, DHRS6, EPHB4, IDI2/GTPBP4, SNTG2, SLC7A6, PMS2L2, KIAA0436, TOSO, THRAP3, T3JAM, LOC283232, LOC92482, PTER, ATM, NUCB2, PIK3R2, MGC1136, CD59, JARID1A, FLJ39616, ABLIM1, PBP, MAPK8IP3, FTS, LHX5, TNFRSF7, MYC, PBXIP1, DATF1, HTF9C, PUS1, KIAA0924, C6orf4, KIAA0372, WDR42A, CRYZL1, TERE1, LTBP4, TTC3, NFATC1, POM121/LOC340318, TOSO, LOC348926/MGC16279/SB153/FLJ10661, SPOCK2, KIAA0515, SLC37A4, CD44, SMARCA2, SPTBN1, C6orf130, TTC3, DLG1, SLC35E2, MCCC1, PMS2L11, RCN3, STX16, FLJ20618, STAT5B, SMARCA2, SATB1, POLR1D, ASXL1, REV1L, PMS2L2/PMS2L5, FLJ12355, CCNB1IP1, FLJ12270, KIAA0692, MCM7, GPSN2, STX16, MMS19L, GTF2I/GTF2IP1, AKAP7, ZNF444, SLC35A3, MGEA5, RUTBC3, C20orf36, RAD17, ALG12, LOC112869, C6orf48, CUTC, LGTN, DEF6, WAC, HNRPH3, NS, KIAA0892, LRPPRC, HMG20A, DDX42, TINP1, ZDHHC17, C19orf2, EIF4B, LOC376745, DKFZP434C171, TH1L, C19orf13, RPL22, PHF15, EWSR1, EIF4B, FAM48A, YT521, NEK9, EIF3S7, RPS6, RPL35A, EEF2, RPL3, RPS6, UBA52, RPL6, RPS6, RPL13, AL353949, AL580863, AF052160, AW128846, AW974481, N92920, BG178274, AW303460, BF057458, AL050035, M59917, AK025422, AI693985, AU158442, AK021460, AL023773, NM_003790, AC005011, M90355, AL353580, U38964, D50683, BE967207, YWHAB, ATP6V1E1, UBB, MRLC2/MRCL3, UQCR, MRLC2, RTN4, UBE2A, RTN4, WDR1, PSMA6, C14orf123, PP1201, TBK1, CAST, CAST, RSN, PSME1, SDF2, GSTO1, CAST, DNCL1, SQRDL, ADIPOR2, ICMT, NDUFA6, NDUFA6, COX17, HIF1AN, FLJ20257, TBPL1, RAPGEF2, CRSP8, APOL1, PAOX, CNDP2, ETFA, DPP3, KPNA1, MGC3036, TUBB2, PDCL, CCL5, CDS2, RAP1GDS1, ATP6V1D, OBRGRP/LEPR, SF4, GCLC, MGST3, BICD2, BRF1, CHST12, EXOSC7, TOR1B, ZFP95, ILK, UNC13A, MTHFD2, CASP10, FLJ45850, CMRF-35H, ARF3, NDOR1, DUSP10, AP1M2, VRK2, GSN, PTRF, RBM19, RABGAP1L, ATP5S, STOM, TFPI2, SLCO3A1, PTPN12, CSF1, SIGLEC6, KIRREL, OBRGRP, TP53AP1, SUHW1, NUP98, IL15RA, MICB, CMRF-35H, SPHK1, TNFRSF6, FLJ11301, LRP5, STOM, EPHA2, SRC, FLJ11301, PSTPIP2, EBP, MCPH1, PTPRF, LIMK2, FSTL4, CBR1, MGC2654, MYCT1, NOL3, MITF, ATP10B, FBXO31, TBX21, LSS, SLC17A3, MNAB, CHPPR, GIF, VAMPS, ABCG2, KIF1B, LOH11CR2A, NID2, RBBP8, ETV7, CTSL, RUFY1, RSU1, PARD3, APOB, ACOX3, DAB2, LDLR, TJP2, GNAS, PARD3, NCKAP1, TAP2, HDGFRP3, LDLR, PIK3R3, HTR2B, GAS2L1, FER1L3, C3orf14, TP53TG3, LEPR, CLIC5, PDE4DIP, ATP9A, ITGB1BP1, INDO, SELP, FHL2, FER1L3, EGF, SIAT8A, HDGFRP3, LRAP, VWF, FLJ10134, IMP-3, DMN, MCTP1, FSTL1, CTNNAL1, RAB27B, THBS1, PROS1, MMRN1, CTTN, AL078596, AI148659, U00956 and M29383.

According to an aspect of some embodiments of the present invention there is provided a kit for predicting a benign or relapsing-remitting course in a subject diagnosed with multiple sclerosis, comprising the probeset of the invention.

According to some embodiments of the invention, the kit further comprising a positive control for an expression level of at least one of the polynucleotides.

According to some embodiments of the invention, the at least one polynucleotide comprises the polynucleotides of RRN3, POLR1D and LRPPRC.

According to some embodiments of the invention, the treatment regimen comprises administering to the subject an agent which downregulates the expression level and/or activity of at least one polynucleotide or polypeptide of the RNA polymerase 1 pathway, thereby treating the subject.

According to some embodiments of the invention, the at least one polynucleotide or polypeptide of the RNA polymerase 1 pathway comprises RRN3.

According to some embodiments of the invention, the at least one polynucleotide or polypeptide of the RNA polymerase 1 pathway further comprises POLR1D and LRPPRC.

According to some embodiments of the invention, the method further comprising determining in the biological sample of the subject the level of expression of POLR1D and/or LRPPRC, wherein upregulation above a predetermined threshold in the level of expression relative to a level of expression of the POLR1D and/or LRPPRC in a biological sample of a subject diagnosed with benign multiple sclerosis (BMS) is indicative of the prediction of the relapsing-remitting multiple sclerosis course of the subject.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

Implementation of the method and/or system of embodiments of the invention can involve performing or completing selected tasks manually, automatically, or a combination thereof. Moreover, according to actual instrumentation and equipment of embodiments of the method and/or system of the invention, several selected tasks could be implemented by hardware, by software or by firmware or by a combination thereof using an operating system.

For example, hardware for performing selected tasks according to embodiments of the invention could be implemented as a chip or a circuit. As software, selected tasks according to embodiments of the invention could be implemented as a plurality of software instructions being executed by a computer using any suitable operating system. In an exemplary embodiment of the invention, one or more tasks according to exemplary embodiments of method and/or system as described herein are performed by a data processor, such as a computing platform for executing a plurality of instructions. Optionally, the data processor includes a volatile memory for storing instructions and/or data and/or a non-volatile storage, for example, a magnetic hard-disk and/or removable media, for storing instructions and/or data. Optionally, a network connection is provided as well. A display and/or a user input device such as a keyboard or mouse are optionally provided as well.

BRIEF DESCRIPTION OF THE SEVERAL VIEWS OF THE DRAWING(S)

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

DESCRIPTION OF SPECIFIC EMBODIMENTS OF THE INVENTION

Figure 1:
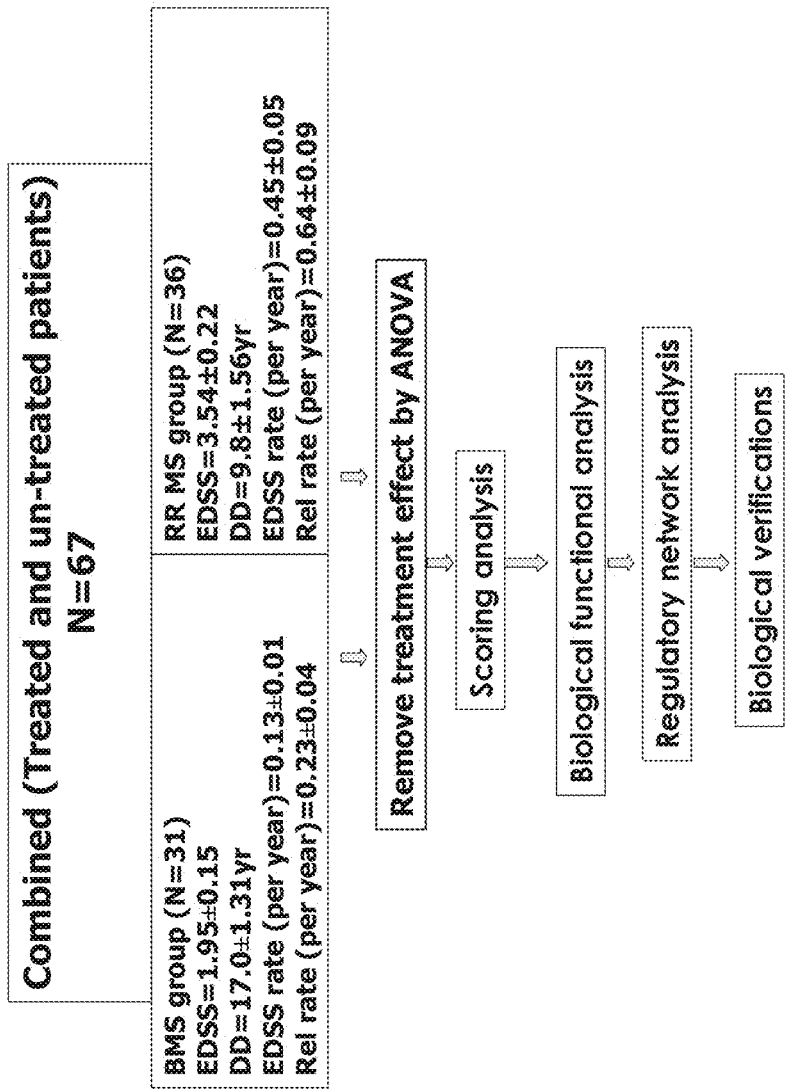
FIG. 1 is a schematic illustration depicting the design of the study for identification of genes which predict benign multiple sclerosis.

The present invention, in some embodiments thereof, relates to methods of classifying a subject as being more likely to have BMS or to be more likely to have typical RRMS and, more particularly, but not exclusively, to methods of diagnosing typical RRMS or BMS and treating a subject based on the diagnosis.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have applied a high throughput gene expression technology to identify biomarkers for the diagnosis of benign multiple sclerosis (BMS) and for potential targets for therapeutic interventions in order switch RRMS course of disease to a BMS course of disease.

Thus, as shown in Example 1 of the Examples section which follows, the present inventors have identified 406 genes which are differentially expressed between multiple sclerosis subjects having a benign MS course or an RRMS course (typical RRMS) (Tables 1 and 2). These genes can be used for classification of MS disease course, diagnosis of a typical RRMS course and selecting a suitable treatment regimen for a subject diagnosed with MS which will prevent deterioration in the subject's state while avoiding unnecessary side effects. In addition, as shown in Table 3 (Example 1) and Tables 4A-C (Example 2) the present inventors have uncovered that the expression level of genes which are involved in the RNA polymerase I pathway such as POLR1D, LRPPRC, RRN3 and NCL is downregulated in subjects having a BMS course of MS as compared to the expression level of these genes in subjects having an RRMS course of MS. Moreover, as shown in Tables 5 and 6 (Example 2) the present inventors identified MIGs (most informative genes) discriminating between BMS and typical RRMS and genes which can classify subjects as having a BMS or a typical RRMS. These results suggest the use of genes involved in the RNA polymerase I pathway as diagnostic markers and drug targets for treating and preventing a typical RRMS course in a subject diagnosed with MS.

Thus, according to an aspect of some embodiments of the invention there is provided a method of classifying a subject as being more likely to have benign multiple sclerosis (BMS) or as being more likely to have typical relapsing remitting multiple sclerosis (RRMS), the method comprising comparing a level of expression of at least one gene involved in the RNA polymerase I pathway in a cell of the subject to a reference expression data of the at least one gene obtained from a cell of at least one subject pre-diagnosed as having BMS and/or from a cell of at least one subject pre-diagnosed as having typical RRMS, thereby classifying the subject as being more likely to have BMS or as being more likely to have typical RRMS.

The term "subject" refers to mammal, preferably a human being.

According to some embodiments of the invention, the subject is diagnosed with multiple sclerosis.

As used herein, the phrase "diagnosed with multiple sclerosis" refers to a subject who experienced at least one neurological attack affecting the central nervous system (CNS) accompanied by demyelinating lesions within the brain or spinal cord, which may have, but not necessarily confirmed by magnetic resonance imaging (MRI). The neurological attack can involve acute or sub-acute neurological symptomatology (attack) manifested by various clinical presentations like unilateral loss of vision, vertigo, ataxia, incoordination, gait difficulties, sensory impairment characterized by paresthesia, dysesthesia, sensory loss, urinary disturbances until incontinence, diplopia, dysarthria, various degrees of motor weakness until paralysis, cognitive decline either as a monosymptomatic or in combination. The symptoms usually remain for several days to few weeks, and then partially or completely resolve.

The accepted diagnostic criteria of multiple sclerosis are presented in Hypertext Transfer Protocol://World Wide Web (dot) mult-sclerosis (dot) org/DiagnosticCriteria (dot) html.

According to some embodiments of the invention, the subject is suspected of having multiple sclerosis.

According to some embodiments of the invention, the subject has probable multiple sclerosis.

According to some embodiments of the invention, the subject does not have a primary progressive course (PPMS).

According to some embodiments of the invention, the subject does not have a secondary progressive MS course (SPMS).

As used herein the term "classifying" refers to determining if the subject is more likely to have benign multiple sclerosis (BMS) or typical relapsing remitting multiple sclerosis (RRMS).

As used herein the phrase "being more likely to have" refers to having increased probability to have a certain disease course (classification of disease) than another disease course.

According to some embodiments of the invention, the phrase "being more likely to have" refers to a probability of at least about 51%, at least about 52%, at least about 53%, at least about 54%, at least about 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., about 100% that the subject has a certain disease course and not the other disease course, i.e., a BMS or typical RRMS.

As used herein, the phrase "benign multiple sclerosis" refers to a subject having MS and exhibiting an Expanded Disability Status Scale (EDSS) of less than 3.0 following at least 10 years from onset and/or diagnosis of MS.

As used herein, the phrase "typical RRMS" or a "relapsing-remitting multiple sclerosis course", which is interchangeably used herein, refers to a subject having MS and exhibiting an Expanded Disability Status Scale (EDSS) higher than 3.0 within less than 10 years of disease onset and/or diagnosis.

The phrase "onset of multiple sclerosis (MS)" as used herein refers to the time of occurrence of the first clinical neurological symptomatology suggestive of MS.

The Kurtzke EDSS is a method scale of quantifying disability in MS by scoring eight Functional Systems (FS) (pyramidal, cerebellar, brainstem, sensory, bowel and bladder, visual, cerebral, and other) and allows neurologists to assign a Functional System Score (FSS) in each and to combine the FSS scores into the EDSS score as follows:

EDSS 0.0—Normal neurological examination;
EDSS 1.0—No disability, minimal signs in one FS;
EDSS 1.5—No disability, minimal signs in more than one FS;
EDSS 2.0—Minimal disability in one FS;
EDSS 2.5—Mild disability in one FS or minimal disability in two FS;
EDSS 3.0—Moderate disability in one FS, or mild disability in three or four FS. Fully ambulatory;
EDSS 3.5—Fully ambulatory but with moderate disability in one FS and more than minimal disability in several others;
EDSS 4.0—Fully ambulatory without aid, self-sufficient, up and about some 12 hours a day despite relatively severe disability; able to walk without aid or rest some 500 meters;
EDSS 4.5—Fully ambulatory without aid, up and about much of the day, able to work a full day, may otherwise have some limitation of full activity or require minimal assistance; characterized by relatively severe disability; able to walk without aid or rest some 300 meters;
EDSS 5.0—Ambulatory without aid or rest for about 200 meters; disability severe enough to impair full daily activities (work a full day without special provisions);
EDSS 5.5—Ambulatory without aid or rest for about 100 meters; disability severe enough to preclude full daily activities;
EDSS 6.0—Intermittent or unilateral constant assistance (cane, crutch, brace) required to walk about 100 meters with or without resting;
EDSS 6.5—Constant bilateral assistance (canes, crutches, braces) required to walk about 20 meters without resting;
EDSS 7.0—Unable to walk beyond approximately five meters even with aid, essentially restricted to wheelchair; wheels self in standard wheelchair and transfers alone; up and about in wheelchair some 12 hours a day;
EDSS 7.5—Unable to take more than a few steps; restricted to wheelchair; may need aid in transfer; wheels self but cannot carry on in standard wheelchair a full day, May require motorized wheelchair;
EDSS 8.0—Essentially restricted to bed or chair or perambulated in wheelchair, but may be out of bed itself much of the day; retains many self-care functions; generally has effective use of arms;
EDSS 8.5—Essentially restricted to bed much of day, has some effective use of arms retains some self care functions;
EDSS 9.0—Confined to bed; can still communicate and eat;
EDSS 9.5—Totally helpless bed patient; unable to communicate effectively or eat/swallow;
EDSS 10.0—Death due to MS;

As mentioned, the diagnosis of MS is performed by clinical neurological symptoms and/or findings such as laboratory tests involving evaluation of IgG synthesis and oligoclonal bands (immunoglobulins) in the cerebrospinal fluid (CSF) which provide evidence of chronic inflammation of the central nervous system, and brain or spinal cord MRI according to the McDonald criteria [McDonald W I, Compston A, Edan G, et al., 2001, "Recommended diagnostic criteria for multiple sclerosis: guidelines from the International Panel on the diagnosis of multiple sclerosis". Ann Neurol. 50 (1): 121-7; Polman C H, Reingold S C, Edan G, et al., 2005, "Diagnostic criteria for multiple sclerosis: 2005 revisions to the "McDonald Criteria"". Ann Neurol. 58 (6): 840-6].

It should be noted that onset of multiple sclerosis and the diagnosis of multiple sclerosis could occur on the same time.

As used herein, the phrase "level of expression" refers to the degree of gene expression and/or gene product activity in a specific cell. For example, up-regulation or down-regulation of various genes can affect the level of the gene product (i.e., RNA and/or protein) in a specific cell.

Sequence information regarding gene products (i.e., RNA transcripts and polypeptide sequences) of the genes of the polynucleotides of the invention such as the genes of RNA polymerase I pathway and of probes which can be used to detect thereof can be found in Tables 1, 2, 3, 5 and 6 of the Examples section which follows.

It should be noted that the level of expression can be determined in arbitrary absolute units, or in normalized units (relative to known expression levels of a control reference). For example, when using DNA chips, the expression levels are normalized according to the chips' internal controls or by using quantile normalization such as RMA.

As used herein the phrase "a cell of the subject" refers to at least one cell (e.g., an isolated cell), cell culture, cell content and/or cell secreted content which contains RNA and/or proteins of the subject. Examples include a blood cell, a cell obtained from any tissue biopsy [e.g., cerebrospinal fluid, (CSF), brain biopsy], a bone marrow cell, body fluids such as plasma, serum, saliva, spinal fluid, lymph fluid, the external sections of the skin, respiratory, intestinal, and genitourinary tracts, tears, saliva, sputum and milk. According to an embodiment of the invention, the cell is a blood cell (e.g., white blood cells, macrophages, B- and T-lymphocytes, monocytes, neutrophiles, eosinophiles, and basophiles) which can be obtained using a syringe needle from a vein of the subject. It should be noted that the cell may be isolated from the subject (e.g., for in vitro detection) or may optionally comprise a cell that has not been physically removed from the subject (e.g., in vivo detection).

According to some embodiments of the invention, the white blood cell comprises peripheral blood mononuclear cells (PBMC). The phrase, "peripheral blood mononuclear cells (PBMCs)" as used herein, refers to a mixture of monocytes and lymphocytes. Several methods for isolating white blood cells are known in the art. For example, PBMCs can be isolated from whole blood samples using density gradient centrifugation procedures. Typically, anticoagulated whole blood is layered over the separating medium. At the end of the centrifugation step, the following layers are visually observed from top to bottom: plasma/platelets, PBMCs, separating medium and erythrocytes/granulocytes. The PBMC layer is then removed and washed to remove contaminants (e.g., red blood cells) prior to determining the expression level of the polynucleotide(s) therein.

The cell or the biological sample comprising same can be obtained from the subject at any time, e.g., immediately after an attack or at any time during remission.

According to some embodiments of the invention, the level of expression of the gene(s) of the invention is determined using an RNA and/or a protein detection method.

According to some embodiments of the invention, the RNA or protein molecules are extracted from the cell of the subject.

Methods of extracting RNA or protein molecules from cells of a subject are well known in the art. Once obtained, the RNA or protein molecules can be characterized for the expression and/or activity level of various RNA and/or protein molecules using methods known in the arts.

Non-limiting examples of methods of detecting RNA molecules in a cell sample include Northern blot analysis, RT-PCR, RNA in situ hybridization (using e.g., DNA or RNA probes to hybridize RNA molecules present in the cells or tissue sections), in situ RT-PCR (e.g., as described in Nuovo G J, et al. Am J Surg Pathol. 1993, 17: 683-90; Komminoth P, et al. Pathol Res Pract. 1994, 190: 1017-25), and oligonucleotide microarray (e.g., by hybridization of polynucleotide sequences derived from a sample to oligonucleotides attached to a solid surface [e.g., a glass wafer) with addressable location, such as Affymetrix microarray (Affymetrix®, Santa Clara, Calif.)].

For example, the level of RRN3 in a sample can be determined by RT-PCR using primers available from Santa Cruz Biotechnology Inc. (sc-106866-PR), or Taqman Gene Expression Assay HS00607907_m1 (Applied Biosystems, Foster City, Calif., USA), according to manufacturer's recommendation.

Non-limiting examples of methods of detecting the level and/or activity of specific protein molecules in a cell sample include Enzyme linked immunosorbent assay (ELISA), Western blot analysis, radio-immunoassay (RIA), Fluorescence activated cell sorting (FACS), immunohistochemical analysis, in situ activity assay (using e.g., a chromogenic substrate applied on the cells containing an active enzyme), in vitro activity assays (in which the activity of a particular enzyme is measured in a protein mixture extracted from the cells). For example, in case the detection of the expression level of a secreted protein is desired, ELISA assay may be performed on a sample of fluid obtained from the subject (e.g., serum), which contains cell-secreted content.

As used herein the phrase "reference expression data" refers to the expression level of the gene in a cell of at least one subject who is pre-diagnosed as having BMS or typical RRMS. Such as an expression level can be known from the literature, from the database, or from biological samples comprising RNA or protein molecules obtained from a reference subject who is already diagnosed as having BMS or typical RRMS.

As used herein the phrase "pre-diagnosed" refers to being diagnosed based on the acceptable clinical tools/markers as described above (e.g., by evaluating the EDSS score after 10 years from onset or diagnosis of MS).

According to some embodiments of the invention, the reference expression data is obtained from at least subject who is pre-diagnosed as having BMS, e.g., from at least 2, from at least 3, from at least 4, from at least 5, from at least 6, from at least 7, from at least 8, from at least 9, from at least 10, from at least 20, from at least 30, from at least 40, from at least 50, from at least 100 or more subjects who are pre-diagnosed as having BMS.

According to some embodiments of the invention, the reference expression data is obtained from at least one subject who is pre-diagnosed as having typical RRMS, e.g., from at least 2, from at least 3, from at least 4, from at least 5, from at least 6, from at least 7, from at least 8, from at least 9, from at least 10, from at least 20, from at least 30, from at least 40, from at least 50, from at least 100 or more subjects who are pre-diagnosed as having typical RRMS.

It should be noted that when more than one reference subjects (i.e., a subject who is pre-diagnosed as having BMS or typical RRMS) is used, the reference expression data may comprise an average of the expression level of several or all subjects, and those of skills in the art are capable of averaging expression levels from 2 or more subject, using e.g., normalized expression values.

According to some embodiments of the invention, a decrease above a predetermined threshold in the level of expression of the at least one gene in the cell of the subject relative to the reference expression data of the at least one gene obtained from a cell of the at least one subject having the typical RRMS classifies the subject as being more likely to have the BMS.

As used herein the phrase "a decrease above a predetermined threshold" refers to a decrease in the level of expression in the cell of the subject relative to the reference expression data obtained from a cell of the at least one subject having the typical RRMS which is higher than a predetermined threshold such as a about 10%, e.g., higher than about 20%, e.g., higher than about 30%, e.g., higher than about 40%, e.g., higher than about 50%, e.g., higher than about 60%, higher than about 70%, higher than about 80%, higher than about 90%, higher than about 2 times, higher than about three times, higher than about four time, higher than about five times, higher than about six times, higher than about seven times, higher than about eight times, higher than about nine times, higher than about 20 times, higher than about 50 times, higher than about 100 times, higher than about 200 times, higher than about 350, higher than about 500 times, higher than about 1000 times, or more relative to the reference expression data obtained from a cell of the at least subject having the typical RRMS.

According to some embodiments of the invention, an increase above a predetermined threshold in the level of expression of the at least one gene in the cell of the subject relative to the reference expression data of the at least one gene obtained from a cell of the at least one subject having the BMS classifies the subject as being more likely to have the typical RRMS.

As used herein the phrase "an increase above a predetermined threshold" refers to an increase in the level of expression in the cell of the subject relative to the reference expression data obtained from a cell of the at least one subject having the BMS which is higher than a predetermined threshold such as a about 10%, e.g., higher than about 20%, e.g., higher than about 30%, e.g., higher than about 40%, e.g., higher than about 50%, e.g., higher than about 60%, higher than about 70%, higher than about 80%, higher than about 90%, higher than about 2 times, higher than about three times, higher than about four time, higher than about five times, higher than about six times, higher than about seven times, higher than about eight times, higher than about nine times, higher than about 20 times, higher than about 50 times, higher than about 100 times, higher than about 200 times, higher than about 350, higher than about 500 times, higher than about 1000 times, or more relative to the reference expression data obtained from a cell of the at least one subject having the BMS.

According to some embodiments of the invention, when a level of expression of the at least one gene in the cell of the subject is identical or changed below a predetermined threshold as compared to the reference expression data of the at least one gene obtained from a cell of the at least one subject having the BMS, then the subject is classified as being more likely to have the BMS.

As used herein the phrase "changed below a predetermined threshold as compared to the reference expression data . . . subject having the BMS" refers to an increase or a decrease in the level of expression in the cell of the subject relative to the reference expression data obtained from a cell of the at least one subject having the BMS which is lower than a predetermined threshold, such as lower than about 10 times, e.g., lower than about 9 times, e.g., lower than about 8 times, e.g., lower than about 7 times, e.g., lower than about 6 times, e.g., lower than about 5 times, e.g., lower than about 4 times, e.g., lower than about 3 times, e.g., lower than about 2 times, e.g., lower than about 90%, e.g., lower than about 80%, e.g., lower than about 70%, e.g., lower than about 60%, e.g., lower than about 50%, e.g., lower than about 40%, e.g., lower than about 30%, e.g., lower than about 20%, e.g., lower than about 10%, e.g., lower than about 9%, e.g., lower than about 8%, e.g., lower than about 7%, e.g., lower than about 6%, e.g., lower than about 5%, e.g., lower than about 4%, e.g., lower than about 3%, e.g., lower than about 2%, e.g., lower than about 1% relative to the reference expression data obtained from the at least one subject having the BMS.

According to some embodiments of the invention, when a level of expression of the at least one gene in the cell of the subject is identical or changed below a predetermined threshold as compared to the reference expression data of the at least one gene obtained from a cell of the at least one subject having the typical RRMS, then the subject is classified as being more likely to have the typical RRMS.

As used herein the phrase "changed below a predetermined threshold as compared to the reference expression data . . . subject having the typical RRMS" refers to an increase or a decrease in the level of expression in the cell of the subject relative to the reference expression data obtained from a cell of the one subject having the typical RRMS which is lower than a predetermined threshold, such as lower than about 10 times, e.g., lower than about 9 times, e.g., lower than about 8 times, e.g., lower than about 7 times, e.g., lower than about 6 times, e.g., lower than about 5 times, e.g., lower than about 4 times, e.g., lower than about 3 times, e.g., lower than about 2 times, e.g., lower than about 90%, e.g., lower than about 80%, e.g., lower than about 70%, e.g., lower than about 60%, e.g., lower than about 50%, e.g., lower than about 40%, e.g., lower than about 30%, e.g., lower than about 20%, e.g., lower than about 10%, e.g., lower than about 9%, e.g., lower than about 8%, e.g., lower than about 7%, e.g., lower than about 6%, e.g., lower than about 5%, e.g., lower than about 4%, e.g., lower than about 3%, e.g., lower than about 2%, e.g., lower than about 1% relative to the reference expression data obtained from the at least one subject having the typical RRMS.

Non-limiting examples of genes involved in the RNA polymerase I pathway which can be used according to the method of the invention are provided in Table 3 along with representative polynucleotides thereof and probes which can be used to detect thereof (Example 1 of the Examples section which follows; e.g., RRN3, LRPPRC, POLR1B, POLR1C, POLR1D, POLR2A, POLR2B, POLR2C, POLR2D, POLR2E, POLR2E, POLR2F, POLR2G, POLR2H, POLR2I, POLR2J, POLR2J2, MGC13098, POLR2K, POLR2L, POLR3B, POLR3C, POLR3D, POLR3E, POLR3F, POLR3G, POLR3K, POLRMT, POLRMT and POLS).

According to some embodiments of the invention, the at least one gene involved in the RNA polymerase 1 pathway is selected from the group consisting of POLR1D, LRPPRC, RRN3 and NCL.

According to some embodiments of the invention, the at least one gene involved in the RNA polymerase 1 pathway is RRN3.

According to some embodiments of the invention, the at least one gene involved in the RNA polymerase 1 pathway is LRPPRC.

According to some embodiments of the invention, the at least one gene involved in the RNA polymerase 1 pathway is POLR1D.

According to some embodiments of the invention, the at least one gene involved in the RNA polymerase 1 pathway comprises RRN3 and POLR1D.

According to some embodiments of the invention, the at least one gene involved in the RNA polymerase 1 pathway comprises RRN3 and LRPPRC.

According to some embodiments of the invention, the at least one gene involved in the RNA polymerase 1 pathway comprises POLR1D and LRPPRC.

According to some embodiments of the invention, the at least one gene involved in the RNA polymerase 1 pathway comprises RRN3, LRPPRC and POLR1D.

According to some embodiments of the invention, the at least one gene involved in the RNA polymerase 1 pathway is RRN3 and NCL.

According to some embodiments of the invention, the at least one gene involved in the RNA polymerase 1 pathway is LRPPRC and NCL.

According to some embodiments of the invention, the at least one gene involved in the RNA polymerase 1 pathway is POLR1D and NCL.

According to some embodiments of the invention, the at least one gene involved in the RNA polymerase 1 pathway comprises RRN3, POLR1D and NCL.

According to some embodiments of the invention, the at least one gene involved in the RNA polymerase 1 pathway comprises RRN3, LRPPRC and NCL.

According to some embodiments of the invention, the at least one gene involved in the RNA polymerase 1 pathway comprises POLR1D, LRPPRC and NCL.

According to some embodiments of the invention, the at least one gene involved in the RNA polymerase 1 pathway comprises RRN3, LRPPRC, POLR1D and NCL.

Tables 4A-C in the Examples section which follows demonstrate exemplary combinations of genes of the RNA polymerase I pathway along with their classification rates for BMS and typical RRMS.

The prediction of the MS course is important in terms of monitoring the clinical state of the subject (e.g., how often does the patient need to be evaluated for the disease progression in terms of neurological evaluation and EDSS), planning of subject's future life (e.g., making decisions regarding marriage, having children, being involved in high risk activities, getting a life-insurance, etc.) and planning the treatment regimen of the subject.

For example, a subject who is more likely to have BMS may be advised to reduce the frequency of neurological clinical evaluations to no more than once per year; to avoid frequent MRI examinations; to not be included in treatment schedule of MS; and/or to avoid receiving immunomodulatory drugs which have side effects or adverse events that can be even life-threatening [e.g., progressive multifocal leukoencephalopathy (PML) in MS patients treated with natalizumab (Tysabri®, Biogen-Idec); Hypertext Transfer Protocol://World Wide Web (dot) va (dot) gov/MS/pressreleases/Treating_Natalizumab_and_Risk_of_PML (dot) asp].

On the other hand, a subject who is more likely to have typical RRMS may be advised to have neurological clinical evaluations at a higher frequency, e.g., about 3-4 times per year; to have frequent MRI examinations; to be included in treatment schedule of MS; and/or to receive immunomodulatory drugs.

It should be noted that the classification of the subject as being more likely to have BMS or typical RRMS can be used to diagnose the subject as having BMS or typical RRMS.

As used herein the term "diagnosing" refers to determining presence or absence of a pathology (e.g., a disease, disorder, condition or syndrome) and/or likelihood of same, classifying a pathology or a symptom, determining a severity of the pathology, monitoring pathology progression, forecasting an outcome of a pathology and/or prospects of recovery and screening of a subject for a specific disease.

According to some embodiments of the invention the method of diagnosing is effected by (a) classifying the subject as being more likely to have BMS or as being more likely to have typical RRMS according to the method of the invention, (i) wherein when the subject is classified as being more likely to have the BMS then the subject is diagnosed as having BMS;

(ii) wherein when the subject is classified as being more likely to have the typical RRMS, then the subject is diagnosed as having typical RRMS; and (c) informing the subject of the diagnosis, thereby diagnosing the subject pre-diagnosed with the MS as having the BMS or the typical RRMS.

According to some embodiments of the invention, the subject is pre-diagnosed with multiple sclerosis (MS), i.e., has a confirmed diagnosis of MS without knowing the disease course, e.g., typical RRMS, BMS.

As used herein the term "informing" refers to providing to the subject the results of the diagnosis of the disease sub-class (i.e., BMS or typical RRMS). The results may be provided as a computer output and/or oral conversation with the subject.

The teachings of the invention can be also used to determine efficiency anti multiple sclerosis drugs by determining the effect of the drug(s) on the expression level of the at least one gene of the RNA polymerase I pathway.

Thus, according to an aspect of some embodiments of the invention, there is provided a method of monitoring an efficiency of an anti multiple sclerosis (MS) drug in treating a subject diagnosed with a typical relapsing remitting multiple sclerosis (RRMS) course, the method is effected by:

(a) treating the subject with the anti MS drug; and (b) comparing a level of expression of least one gene involved in the RNA polymerase I pathway in a cell of the subject following treating with the anti MS drug to a level of expression of the at least one gene in a cell of the subject prior to the treating the subject with the anti MS drug, (i) wherein a decrease above a predetermined threshold in the level of expression of the at least one gene following the treating with the anti MS drug relative to the level of expression of the at least one gene prior to the treating with the anti MS drug indicates that the anti MS drug is efficient for treating the subject;

(ii) wherein an increase above a predetermined threshold in the level of expression of the at least one gene following the treating with the anti MS drug relative to the level of expression of the at least one gene prior to the treating with the anti MS drug indicates that the anti MS drug is not efficient for treating the subject; or (iii) wherein when a level of expression of the at least one gene following the treating with the anti MS drug is identical or changed below a predetermined threshold as compared to prior to the treating with the anti MS drug then the treatment is not efficient for treating the subject.

thereby monitoring the efficiency of the anti multiple sclerosis (MS) drug in treating the subject diagnosed with the typical RRMS course.

As used herein the phrase "treating" refers to inhibiting or arresting the development of pathology [multiple sclerosis, e.g., typical RRMS] and/or causing the reduction, remission, or regression of a pathology and/or optimally curing the pathology. Those of skill in the art will understand that various methodologies and assays can be used to assess the development of pathology, and similarly, various methodologies and assays may be used to assess the reduction, remission or regression of the pathology.

According to some embodiments of the invention, treating the subject refers to changing the disease course of the subject from a typical RRMS course to a BMS course.

According to some embodiments of the invention, treating the subject refers to preventing a typical RRMS course.

As used herein the phrase "following treating with the anti MS drug" refers to any time period after administering the anti MS drug to the subject, e.g., from a few minutes to hours, or from a few days to weeks or months after drug administration.

According to some embodiments of the invention the level of expression is determined following the first dose of the anti MS drug.

According to some embodiments of the invention the level of expression is determined following any dose of the anti MS drug.

As used herein the phrase "prior to treating with the anti MS drug" refers to any time period prior administering the anti MS drug to the subject, e.g., from a few minutes to hours, or from a few days to weeks or months prior to drug administration.

According to some embodiments of the invention the level of expression is determined prior any dose of the anti MS drug (e.g., when the subject is naïve to treatment).

According to some embodiments of the invention prior to treating refers to when the subject is first diagnosed with multiple sclerosis.

According to some embodiments of the invention prior to treating refers to when the subject is suspected of having multiple sclerosis, or diagnosed with probable multiple sclerosis.

According to some embodiments of the invention prior to treating refers to upon MS disease onset.

According to some embodiments of the invention the effect of the treatment on the subject can be evaluated by monitoring the level of expression of at least one of the polynucleotides described hereinabove. For example, down-regulation in the level of RRN3 in the subject following treatment can be indicative of the positive effect of the treatment on the subject, i.e., switching from a typical RRMS to a BMS course of disease.

The teachings of the invention can be also used to predict efficiency of a drug in vitro.

Thus, according to an aspect of some embodiments of the invention there is provided an in vitro method of predicting an efficiency of an anti multiple sclerosis (MS) drug for treatment of a subject diagnosed with a typical relapsing remitting multiple sclerosis (RRMS), the method is effected by:

(a) contacting cells of the subject with a therapeutically effective amount of the anti MS drug; and (b) comparing a level of expression in the cells of at least one gene involved in the RNA polymerase I pathway following the contacting with the anti MS drug to a level of expression of the at least one gene in the cells prior to the contacting with the anti MS drug, (i) wherein a decrease above a predetermined threshold in the level of expression of the at least one gene following the contacting with the anti MS drug relative to the level of expression of the at least one gene prior to the contacting with the anti MS drug indicates that the treatment is efficient for treating the subject;

(ii) wherein an increase above a predetermined threshold in the level of expression of the at least one gene following the contacting with the anti MS drug relative to the level of expression of the at least one gene prior to the contacting with the anti MS drug indicates that the treatment is not efficient for treating the subject; or (iii) wherein when a level of expression of the at least one gene following the contacting with the anti MS drug is identical or changed below a predetermined threshold as compared to prior to the contacting with the anti MS drug then the treatment is not efficient for treating the subject.

thereby predicting the efficiency of the anti MS drug for treatment of the subject diagnosed with the typical RRMS.

Contacting cells with the anti MS drug can be performed by any in vitro conditions including for example, adding the anti MS drug to cells derived from a subject (e.g., a primary cell culture, a cell line) or to a biological sample comprising same (e.g., a fluid, liquid which comprises the cells) such that the drug is in direct contact with the cells. According to some embodiments of the invention, the cells of the subject are incubated with the anti MS drug. The conditions used for incubating the cells are selected for a time period/concentration of cells/concentration of drug/ratio between cells and drug and the like which enable the drug to induce cellular changes, such as changes in transcription and/or translation rate of specific genes, proliferation rate, differentiation, cell death, necrosis, apoptosis and the like.

Methods of monitoring cellular changes induced by the drugs are known in the art and include for example, the MTT test which is based on the selective ability of living cells to reduce the yellow salt MTT (3-(4,5-dimethylthiazolyl-2)-2,5-diphenyltetrazolium bromide) (Sigma, Aldrich St Louis, Mo., USA) to a purple-blue insoluble formazan precipitate; the BrDu assay [Cell Proliferation ELISA BrdU colorimetric kit (Roche, Mannheim, Germany]; the TUNEL assay [Roche, Mannheim, Germany]; the Annexin V assay [ApoAlert® Annexin V Apoptosis Kit (Clontech Laboratories, Inc., CA, USA)]; the Senescence associated-β-galactosidase assay (Dimri G P, Lee X, et al. 1995. A biomarker that identifies senescent human cells in culture and in aging skin in vivo. Proc Natl Acad Sci USA 92:9363-9367); as well as various RNA and protein detection methods (which detect level of expression and/or activity) which are further described hereinabove.

According to some embodiments of the invention, the cells are incubated under conditions which enable the effect of the drug on cellular processes such as downregulation of the at least one gene of the RNA polymerase I pathway.

According to an aspect of some embodiments of the invention there is provided a method of treating a subject diagnosed with multiple sclerosis, the method is effected by: (a) classifying the subject as being more likely to have BMS or typical RRMS according to the method of the invention, (b) selecting a treatment regimen based on classification results of step (a); thereby treating the subject diagnosed with multiple sclerosis.

As used herein the phrase "treatment regimen" refers to a treatment plan that specifies the type of treatment, dosage, schedule and/or duration of a treatment provided to a subject in need thereof (e.g., a subject diagnosed with MS). The selected treatment regimen can be an aggressive one which is expected to result in the best clinical outcome (e.g., complete cure of the pathology) or a more moderate one which may relief symptoms of the pathology yet results in incomplete cure of the pathology. It will be appreciated that in certain cases the more aggressive treatment regimen may be associated with some discomfort to the subject or adverse side effects (e.g., a damage to healthy cells or tissue). The dosage, schedule and duration of treatment can vary, depending on the severity of pathology and the selected type of treatment, and those of skills in the art are capable of adjusting the type of treatment with the dosage, schedule and duration of treatment.

For example, when the subject is classified as being more likely to have typical RRMS (or being diagnosed with typical RRMS) then the treatment regimen is an aggressive therapy such as an immunomodulation therapy, e.g., a high dosage of interferon beta 1a [Rebif, which can be administered subcutaneously, at a dosage of e.g., 44 µg, three times a week].

MS drugs which can be administered to a subject predicted to have an RRMS course of disease according to the present teachings include, but are not limited to Diterpenoid triepoxide Triptolide (TPT), Adderall; Ambien; Avonex; Baclofen; Beta interferon; Betaseron; Celexa; Clonazepam; Copaxone; Corticosteroids; Cymbalta; Cytoxan; Dexamethasone; Effexor; Elavil; Gabapentin; Hydrocodone; Lexapro; Lyrica; Mitoxantrone; Naltrexone; Neurontin; Novantrone; Prednisone; Provigil; Rebif; Solumedrol; Symmetrel; Topamax; Tysabri; Wellbutrin; Xanax; Zanaflex; Zoloft; Novartis' fingolimod [sphingosine 1-phosphate receptor (S1P-R) modulator]; Teva's laquinimod; Merck KGaA's Mylinax (cladribine); Sanofi-aventis' teriflunomide; Biogen Idec's BG-12 (Phase III); GSK/Mitsubishi Tanabe Pharma's firategrast; MediciNova's ibudilast; Biogen/UCB's CDP323 (Phase II).

One the other hand, when the subject is classified as being more likely to have BMS (or is diagnosed with BMS) then the aggressive treatment is not recommended, and these patients would not be treated or treatment can be delayed.

In addition, knowing the prediction or classification of MS disease course (BMS or typical RRMS) is highly beneficial in terms of saving un-necessary costs to the health system.

According to an aspect of some embodiments of the invention there is provided a method of treating a subject diagnosed with multiple sclerosis, the method is effected by (a) diagnosing a typical relapsing remitting multiple sclerosis (RRMS) according to the method of the invention, and (b) administering to the subject a therapeutically effective amount of diterpenoid triepoxide Triptolide (TPT) or a derivative thereof, thereby treating the subject TPT derivatives and preparation thereof are described in WO9852933A1, which is fully incorporated herein by reference. Non-limiting examples of TPT derivatives include, compounds of the general formulas.

Formula (1)

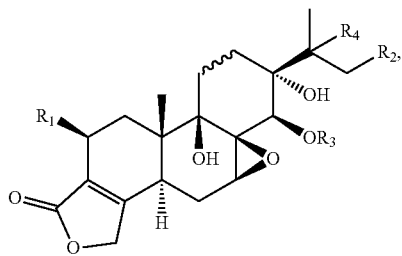

formula (2)

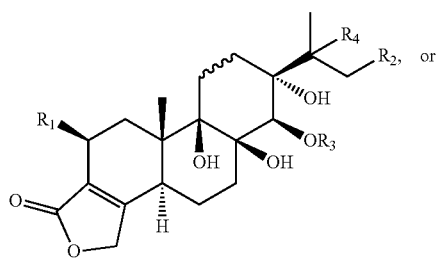

-continued formula (3)

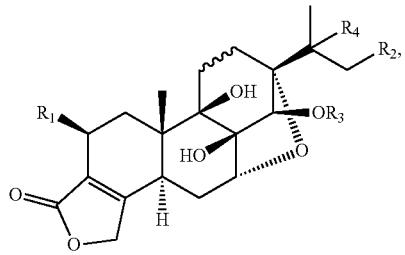

Wherein

∼ represents a single or double bond;
$R_1$ and $R_2$ each independently is H or —$OR_5$;
R3 is H, —C(═O)(CH2)nCO2H or a suitable amino acid;
$R_1$ is H or —OH; $R_1$ is H, —C(═O)(CH2)nCO2H or a suitable amino acid;
n is the integer 2, 3, 4, 5 or 6;
and the stereoisomers, enantiomers and pharmaceutically acceptable salts thereof; provided that R, and R2 are H when R, is other than H (for further details see WO9852933A1).

A commercially available preparation of Triptolide which can be used according to the teachings of the invention is Trisoxireno(4b,5:6,7:8a,9)phenanthro(1,2-c)furan-1(3H)-one, 3b,4,4a,6,6a,7a,7b,8b,9,10-decahydro-6-hydroxy-8b-methyl-6a-(1-methylethyl)-, (3bS,4aS,5aS,6R,6aR,7aS,7bS,8aS,8bS)-[CAS No.: 38748-32-2; PG490, Chengdu Biopurify Phytochemicals Ltd. Chengdu, Sichuan, China].

According to some embodiments of the invention, when the subject is more likely to have typical RRMS then the treatment regimen comprises administering to the subject an agent which downregulates the level of expression of the at least one gene involved in the RNA polymerase I pathway.

According to some embodiments of the invention, treating the subject is effected by downregulating the expression level and/or activity (RNA and/or polypeptide encoded thereby) of at least one polynucleotide of the polymerase I pathway (for details see the list of genes/polynucleotide in Table 3 in Example 1 of the Examples section which follows).

Following is a list of downregulating agents which can decrease the expression level of the gene product (RNA or protein molecules) of at least one of the polynucleotides of the polymerase I pathway.

Downregulation can be effected on the genomic and/or the transcript level using a variety of molecules which interfere with transcription and/or translation (e.g., RNA silencing agents, Ribozyme, DNAzyme and antisense), or on the protein level using e.g., an antibody, antagonists, enzymes that cleave the polypeptide and the like.

One example, of an agent capable of downregulating a polypeptide-of-interest is an antibody or antibody fragment capable of specifically binding the polypeptide-of-interest. Preferably, the antibody specifically binds at least one epitope of the polypeptide-of-interest. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

The term "antibody" as used in this invention includes intact molecules as well as functional fragments thereof, such as Fab, F(ab')2, and Fv that are capable of binding to macrophages. These functional antibody fragments are defined as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments directly and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab').sub.2 or other antigen-binding subsequences of antibodies) which contain minimal sequence derived from non-human immunoglobulin. Humanized antibodies include human immunoglobulins (recipient antibody) in which residues form a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321:522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

In case the target antigen (the protein which is detected by the antibody) is presented within the cell, the antibody of the invention can be expressed within the cell intracellular antibodies (also known as "intrabodies") or a particular compartment thereof. Intrabodies are essentially SCA to which intracellular localization signals have been added (e.g., ER, mitochondrial, nuclear, cytoplasmic). This technology has been successfully applied in the art (for review, see Richardson and Marasco, 1995, TIBTECH vol. 13). Intrabodies have been shown to virtually eliminate the expression of otherwise abundant cell surface receptors and to inhibit a protein function within a cell (See, for example, Richardson et al., 1995, Proc. Natl. Acad. Sci. USA 92: 3137-3141; Deshane et al., 1994, Gene Ther. 1: 332-337; Marasco et al., 1998 Human Gene Ther 9: 1627-42; Shaheen et al., 1996 J. Virol. 70: 3392-400; Werge, T. M. et al., 1990, FEBS Letters 274:193-198; Carlson, J. R. 1993 Proc. Natl. Acad. Sci. USA 90:7427-7428; Biocca, S. et al., 1994, Bio/Technology 12: 396-399; Chen, S-Y. et al., 1994, Human Gene Therapy 5:595-601; Duan, L et al., 1994, Proc. Natl. Acad. Sci. USA 91:5075-5079; Chen, S-Y. et al., 1994, Proc. Natl. Acad. Sci. USA 91:5932-5936; Beerli, R. R. et al., 1994, J. Biol. Chem. 269:23931-23936; Mhashilkar, A. M. et al., 1995, EMBO J. 14:1542-1551; PCT Publication No. WO 94/02610 by Marasco et al.; and PCT Publication No. WO 95/03832 by Duan et al.).

To prepare an intracellular antibody expression vector, the cDNA encoding the antibody light and heavy chains specific for the target protein of interest are isolated, typically from a hybridoma that secretes a monoclonal antibody specific for the marker. Hybridomas secreting anti-marker monoclonal antibodies, or recombinant monoclonal antibodies, can be prepared using methods known in the art. Once a monoclonal antibody specific for the marker protein is identified (e.g., either a hybridoma-derived monoclonal antibody or a recombinant antibody from a combinatorial library), DNAs encoding the light and heavy chains of the monoclonal antibody are isolated by standard molecular biology techniques. For hybridoma derived antibodies, light and heavy chain cDNAs can be obtained, for example, by PCR amplification or cDNA library screening. For recombinant antibodies, such as from a phage display library, cDNA encoding the light and heavy chains can be recovered from the display package (e.g., phage) isolated during the library screening process and the nucleotide sequences of antibody light and heavy chain genes are determined. For example, many such sequences are disclosed in Kabat, E. A., et al. (1991) Sequences of Proteins of Immunological Interest, Fifth Edition, U.S. Department of Health and Human Services, NIH Publication No. 91-3242 and in the "Vbase" human germline sequence database. Once obtained, the antibody light and heavy chain sequences are cloned into a recombinant expression vector using standard methods.

For cytoplasmic expression of the light and heavy chains, the nucleotide sequences encoding the hydrophobic leaders of the light and heavy chains are removed. An intracellular antibody expression vector can encode an intracellular antibody in one of several different forms. For example, in one embodiment, the vector encodes full-length antibody light and heavy chains such that a full-length antibody is expressed intracellularly. In another embodiment, the vector encodes a full-length light chain but only the VH/CH1 region of the heavy chain such that a Fab fragment is expressed intracellularly. In another embodiment, the vector encodes a single chain antibody (scFv) wherein the variable regions of the light and heavy chains are linked by a flexible peptide linker [e.g., $(Gly_4Ser)_3$ and expressed as a single chain molecule. To inhibit marker activity in a cell, the expression vector encoding the intracellular antibody is introduced into the cell by standard transfection methods, as discussed hereinbefore.

Once antibodies are obtained, they may be tested for activity, for example via ELISA.

Downregulation of the polynucleotide-of-interest can be also achieved by RNA silencing. As used herein, the phrase "RNA silencing" refers to a group of regulatory mechanisms [e.g. RNA interference (RNAi), transcriptional gene silencing (TGS), post-transcriptional gene silencing (PTGS), quelling, co-suppression, and translational repression] mediated by RNA molecules which result in the inhibition or "silencing" of the expression of a corresponding protein-coding gene. RNA silencing has been observed in many types of organisms, including plants, animals, and fungi.

As used herein, the term "RNA silencing agent" refers to an RNA which is capable of inhibiting or "silencing" the expression of a target gene. In certain embodiments, the RNA silencing agent is capable of preventing complete processing (e.g., the full translation and/or expression) of an mRNA molecule through a post-transcriptional silencing mechanism. RNA silencing agents include noncoding RNA molecules, for example RNA duplexes comprising paired strands, as well as precursor RNAs from which such small non-coding RNAs can be generated. Exemplary RNA silencing agents include dsRNAs such as siRNAs, miRNAs and shRNAs. In one embodiment, the RNA silencing agent is capable of inducing RNA interference. In another embodiment, the RNA silencing agent is capable of mediating translational repression.

The RNA silencing agent can be directed to a specific compartment within the cells, such as to the nucleus (see e.g., Shim M S and Kwon Y J. 2009, "Controlled cytoplasmic and nuclear localization of plasmid DNA and siRNA by differentially tailored polyethylenimine"; J. Control Release. 133:206-13, Epub 2008 Nov. 1), nucleoli, and the like.

RNA interference refers to the process of sequence-specific post-transcriptional gene silencing in animals mediated by short interfering RNAs (siRNAs). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla. Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA.

The presence of long dsRNAs in cells stimulates the activity of a ribonuclease III enzyme referred to as dicer. Dicer is involved in the processing of the dsRNA into short pieces of dsRNA known as short interfering RNAs (siRNAs). Short interfering RNAs derived from dicer activity are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex.

Accordingly, the present invention contemplates use of dsRNA to downregulate protein expression from mRNA.

According to one embodiment, the dsRNA is greater than 30 bp. The use of long dsRNAs (i.e. dsRNA greater than 30 bp) has been very limited owing to the belief that these longer regions of double stranded RNA will result in the induction of the interferon and PKR response. However, the use of long dsRNAs can provide numerous advantages in that the cell can select the optimal silencing sequence alleviating the need to test numerous siRNAs; long dsRNAs will allow for silencing libraries to have less complexity than would be necessary for siRNAs; and, perhaps most importantly, long dsRNA could prevent viral escape mutations when used as therapeutics.

Various studies demonstrate that long dsRNAs can be used to silence gene expression without inducing the stress response or causing significant off-target effects—see for example [Strat et al., Nucleic Acids Research, 2006, Vol. 34, No. 13 3803-3810; Bhargava A et al. Brain Res. Protoc. 2004; 13:115-125; Diallo M., et al., Oligonucleotides. 2003; 13:381-392; Paddison P. J., et al., Proc. Natl Acad. Sci. USA. 2002; 99:1443-1448; Tran N., et al., FEBS Lett. 2004; 573:127-134].

In particular, the present invention also contemplates introduction of long dsRNA (over 30 base transcripts) for gene silencing in cells where the interferon pathway is not activated (e.g. embryonic cells and oocytes) see for example Billy et al., PNAS 2001, Vol 98, pages 14428-14433. and Diallo et al, Oligonucleotides, Oct. 1, 2003, 13(5): 381-392. doi:10.1089/154545703322617069.

The present invention also contemplates introduction of long ds-RNA specifically designed not to induce the interferon and PKR pathways for downregulating gene expression. For example, Shinagwa and Ishii [Genes & Dev. 17 (11): 1340-1345, 2003] have developed a vector, named pDECAP, to express long double-strand RNA from an RNA polymerase II (Pol II) promoter. Because the transcripts from pDECAP lack both the 5'-cap structure and the 3'-poly (A) tail that facilitate ds-RNA export to the cytoplasm, long ds-RNA from pDECAP does not induce the interferon response.

Another method of evading the interferon and PKR pathways in mammalian systems is by introduction of small inhibitory RNAs (siRNAs) either via transfection or endogenous expression.

The term "siRNA" refers to small inhibitory RNA duplexes (generally between 18-30 basepairs) that induce the RNA interference (RNAi) pathway. Typically, siRNAs are chemically synthesized as 21 mers with a central 19 bp duplex region and symmetric 2-base 3'-overhangs on the termini, although it has been recently described that chemically synthesized RNA duplexes of 25-30 base length can have as much as a 100-fold increase in potency compared with 21 mers at the same location. The observed increased potency obtained using longer RNAs in triggering RNAi is theorized to result from providing Dicer with a substrate (27 mer) instead of a product (21 mer) and that this improves the rate or efficiency of entry of the siRNA duplex into RISC.

It has been found that position of the 3'-overhang influences potency of an siRNA and asymmetric duplexes having a 3'-overhang on the antisense strand are generally more potent than those with the 3'-overhang on the sense strand (Rose et al., 2005). This can be attributed to asymmetrical strand loading into RISC, as the opposite efficacy patterns are observed when targeting the antisense transcript.

The strands of a double-stranded interfering RNA (e.g., an siRNA) may be connected to form a hairpin or stem-loop structure (e.g., an shRNA). Thus, as mentioned the RNA silencing agent of the present invention may also be a short hairpin RNA (shRNA).

A non-limiting example for an siRNA which can be used to down regulate RRN3 (RNA polymerase I transcription factor homolog) expression level in a cell of a subject is Rrn3 siRNA (h): sc-106866 (Santa Cruz Biotechnology, Inc. Santa Cruz, Calif., USA). In addition, downregulation of RRN3 can be achieved by Rrn3 shRNA plasmid (h): sc-106866-SH and Rrn3 shRNA (h) Lentiviral Particles: sc-106866-V ((Santa Cruz Biotechnology, Inc. Santa Cruz, Calif., USA).

The term "shRNA", as used herein, refers to an RNA agent having a stem-loop structure, comprising a first and second region of complementary sequence, the degree of complementarity and orientation of the regions being sufficient such that base pairing occurs between the regions, the first and second regions being joined by a loop region, the loop resulting from a lack of base pairing between nucleotides (or nucleotide analogs) within the loop region. The number of nucleotides in the loop is a number between and including 3 to 23, or 5 to 15, or 7 to 13, or 4 to 9, or 9 to 11. Some of the nucleotides in the loop can be involved in base-pair interactions with other nucleotides in the loop. Examples of oligonucleotide sequences that can be used to form the loop include 5'-UUCAAGAGA-3' (Brummelkamp, T. R. et al. (2002) Science 296: 550) and 5'-UUUGUGUAG-3' (Castanotto, D. et al. (2002) RNA 8:1454). It will be recognized by one of skill in the art that the resulting single chain oligonucleotide forms a stem-loop or hairpin structure comprising a double-stranded region capable of interacting with the RNAi machinery.

According to another embodiment the RNA silencing agent may be a miRNA. miRNAs are small RNAs made from genes encoding primary transcripts of various sizes. They have been identified in both animals and plants. The primary transcript (termed the "pri-miRNA") is processed through various nucleolytic steps to a shorter precursor miRNA, or "pre-miRNA." The pre-miRNA is present in a folded form so that the final (mature) miRNA is present in a duplex, the two strands being referred to as the miRNA (the strand that will eventually basepair with the target) The pre-miRNA is a substrate for a form of dicer that removes the miRNA duplex from the precursor, after which, similarly to siRNAs, the duplex can be taken into the RISC complex. It has been demonstrated that miRNAs can be transgenically expressed and be effective through expression of a precursor form, rather than the entire primary form (Parizotto et al.

(2004) Genes & Development 18:2237-2242 and Guo et al. (2005) Plant Cell 17:1376-1386).

Unlike, siRNAs, miRNAs bind to transcript sequences with only partial complementarity (Zeng et al., 2002, Molec. Cell 9:1327-1333) and repress translation without affecting steady-state RNA levels (Lee et al., 1993, Cell 75:843-854; Wightman et al., 1993, Cell 75:855-862). Both miRNAs and siRNAs are processed by Dicer and associate with components of the RNA-induced silencing complex (Hutvagner et al., 2001, Science 293:834-838; Grishok et al., 2001, Cell 106: 23-34; Ketting et al., 2001, Genes Dev. 15:2654-2659; Williams et al., 2002, Proc. Natl. Acad. Sci. USA 99:6889-6894; Hammond et al., 2001, Science 293:1146-1150; Mourlatos et al., 2002, Genes Dev. 16:720-728). A recent report (Hutvagner et al., 2002, Sciencexpress 297:2056-2060) hypothesizes that gene regulation through the miRNA pathway versus the siRNA pathway is determined solely by the degree of complementarity to the target transcript. It is speculated that siRNAs with only partial identity to the mRNA target will function in translational repression, similar to an miRNA, rather than triggering RNA degradation.

Synthesis of RNA silencing agents suitable for use with the present invention can be effected as follows. First, the mRNA sequence of the polynucleotide-of-interest is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tusch1 ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (www.ambion.com/techlib/tn/91/912.html).

Second, potential target sites are compared to an appropriate genomic database (e.g., human, mouse, rat etc.) using any sequence alignment software, such as the BLAST software available from the NCBI server (www.ncbi.nlm nih gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

It will be appreciated that the RNA silencing agent of the present invention need not be limited to those molecules containing only RNA, but further encompasses chemically-modified nucleotides and non-nucleotides.

In some embodiments, the RNA silencing agent provided herein can be functionally associated with a cell-penetrating peptide. As used herein, a "cell-penetrating peptide" is a peptide that comprises a short (about 12-30 residues) amino acid sequence or functional motif that confers the energy-independent (i.e., non-endocytotic) translocation properties associated with transport of the membrane-permeable complex across the plasma and/or nuclear membranes of a cell. The cell-penetrating peptide used in the membrane-permeable complex of the present invention preferably comprises at least one non-functional cysteine residue, which is either free or derivatized to form a disulfide link with a double-stranded ribonucleic acid that has been modified for such linkage. Representative amino acid motifs conferring such properties are listed in U.S. Pat. No. 6,348,185, the contents of which are expressly incorporated herein by reference. The cell-penetrating peptides of the present invention preferably include, but are not limited to, penetratin, transportan, pIsl, TAT(48-60), pVEC, MTS, and MAP.

mRNAs to be targeted using RNA silencing agents include, but are not limited to, those whose expression is correlated with an undesired phenotypic trait. Exemplary mRNAs that may be targeted are those that encode truncated proteins i.e. comprise deletions. Accordingly the RNA silencing agent of the present invention may be targeted to a bridging region on either side of the deletion. Introduction of such RNA silencing agents into a cell would cause a down-regulation of the mutated protein while leaving the non-mutated protein unaffected.

Another agent capable of downregulating the polynucleotide-of-interest is a DNAzyme molecule capable of specifically cleaving an mRNA transcript or DNA sequence of the polynucleotide-of-interest. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943:4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 20002, Abstract 409, Ann Meeting Am Soc Gen Ther World Wide Web (dot) asgt (dot) org). In another application, DNAzymes complementary to bcr-ab1 oncogenes were successful in inhibiting the oncogenes expression in leukemia cells, and lessening relapse rates in autologous bone marrow transplant in cases of CML and ALL.

Downregulation of the polynucleotide-of-interest can also be effected by using an antisense polynucleotide capable of specifically hybridizing with an mRNA transcript encoding the polynucleotide-of-interest.

Design of antisense molecules which can be used to efficiently downregulate the polynucleotide-of-interest must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p53 and Bcl-2 had entered clinical trials and had been shown to be tolerated by patients [Gerwitz Curr Opin Mol Ther 1:297-306 (1999)].

More recently, antisense-mediated suppression of human heparanase gene expression has been reported to inhibit pleural dissemination of human cancer cells in a mouse model [Uno et al., Cancer Res 61:7855-60 (2001)].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Another agent capable of downregulating the polynucleotide-of-interest is a ribozyme molecule capable of specifically cleaving an mRNA transcript encoding the polynucleotide-of-interest. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA has rendered them valuable tools in both basic research and therapeutic applications. In the therapeutics area, ribozymes have been exploited to target viral RNAs in infectious diseases, dominant oncogenes in cancers and specific somatic mutations in genetic disorders [Welch et al., Clin Diagn Virol. 10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

An additional method of regulating the expression of the polynucleotide-of-interest in cells is via triplex forming oligonuclotides (TFOs). Recent studies have shown that TFOs can be designed which can recognize and bind to polypurine/polypirimidine regions in double-stranded helical DNA in a sequence-specific manner. These recognition rules are outlined by Maher III, L. J., et al., Science, 1989; 245:725-730; Moser, H. E., et al., Science, 1987; 238:645-630; Beal, P. A., et al, Science, 1992; 251:1360-1363; Cooney, M., et al., Science, 1988; 241:456-459; and Hogan, M. E., et al., EP Publication 375408. Modification of the oligonuclotides, such as the introduction of intercalators and backbone substitutions, and optimization of binding conditions (pH and cation concentration) have aided in overcoming inherent obstacles to TFO activity such as charge repulsion and instability, and it was recently shown that synthetic oligonucleotides can be targeted to specific sequences (for a recent review see Seidman and Glazer, J Clin Invest 2003; 112:487-94).

Another agent capable of downregulating the expression level of the polynucleotide-of-interest is a small molecule which inhibits the activity, level and/or interactions of the gene product of polynucleotide-of-interest, such as by interfering with the pathway in which the gene product of the polynucleotide-of-interest is involved.

Non-limiting examples of small molecules which can be used along with the method of the invention to treat the subject include Cycloheximide and diterpenoid triepoxide Triptolide (TPT) or a derivative thereof.

For example, when RRN3 is upregulated in the typical RRMS subject then the treatment can be with diterpenoid triepoxide Triptolide (TPT) or a derivative thereof; and/or with Cycloheximide or a derivative thereof.

Any of the downregulating agents described hereinabove (e.g., the agent which downregulates the gene of the RNA polymerase I pathway, e.g., siRNA, antibody) can be provided to the subject in need thereof along with any of the known multiple sclerosis therapies (e.g., the anti MS drugs) described hereinabove (combination therapy) and/or with Triptolide or a derivative thereof.

Any of the downregulating agents described above can be administered to the subject per se, or in a pharmaceutical composition where it is mixed with suitable carriers or excipients.

As used herein a "pharmaceutical composition" refers to a preparation of one or more of the active ingredients described herein with other chemical components such as physiologically suitable carriers and excipients. The purpose of a pharmaceutical composition is to facilitate administration of a compound to an organism.

Herein the term "active ingredient" refers to the down-regulating agent accountable for the biological effect.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases.

Herein the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils and polyethylene glycols.

Techniques for formulation and administration of drugs may be found in "Remington's Pharmaceutical Sciences," Mack Publishing Co., Easton, Pa., latest edition, which is incorporated herein by reference.

Suitable routes of administration may, for example, include oral, rectal, transmucosal, especially transnasal, intestinal or parenteral delivery, including intramuscular, subcutaneous and intramedullary injections as well as intrathecal, direct intraventricular, intracardiac, e.g., into the right or left ventricular cavity, into the common coronary artery, intravenous, intraperitoneal, intranasal, or intraocular injections.

For example, the pharmaceutical composition may be administered using a dermal patch which releases the active ingredient [e.g., Diterpenoid triepoxide Triptolide (TPT) has a molecular weight of 360.40 and it will thus be suitable to be used in a dermal patch].

Conventional approaches for drug delivery to the central nervous system (CNS) include: neurosurgical strategies (e.g., intracerebral injection or intracerebroventricular infusion); molecular manipulation of the agent (e.g., production of a chimeric fusion protein that comprises a transport peptide that has an affinity for an endothelial cell surface molecule in combination with an agent that is itself incapable of crossing the BBB) in an attempt to exploit one of the endogenous transport pathways of the BBB; pharmacological strategies designed to increase the lipid solubility of an agent (e.g., conjugation of water-soluble agents to lipid or cholesterol carriers); and the transitory disruption of the integrity of the BBB by hyperosmotic disruption (resulting from the infusion of a mannitol solution into the carotid artery or the use of a biologically active agent such as an angiotensin peptide). However, each of these strategies has limitations, such as the inherent risks associated with an invasive surgical procedure, a size limitation imposed by a limitation inherent in the endogenous transport systems, potentially undesirable biological side effects associated with the systemic administration of a chimeric molecule comprised of a carrier motif that could be active outside of the CNS, and the possible risk of brain damage within regions of the brain where the BBB is disrupted, which renders it a suboptimal delivery method.

Alternately, one may administer the pharmaceutical composition in a local rather than systemic manner, for example, via injection of the pharmaceutical composition directly into a tissue region of a patient.

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention thus may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the pharmaceutical composition may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the pharmaceutical composition can be formulated readily by combining the active compounds with pharmaceutically acceptable carriers well known in the art. Such carriers enable the pharmaceutical composition to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The pharmaceutical composition described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The pharmaceutical composition of the present invention may also be formulated in rectal compositions such as suppositories or retention enemas, using, e.g., conventional suppository bases such as cocoa butter or other glycerides.

Pharmaceutical compositions suitable for use in context of the present invention include compositions wherein the active ingredients are contained in an amount effective to achieve the intended purpose. More specifically, a therapeutically effective amount means an amount of active ingredients (the downregulating agent) effective to prevent, alleviate or ameliorate symptoms of a disorder (e.g., RRMS) or prolong the survival of the subject being treated.

Determination of a therapeutically effective amount is well within the capability of those skilled in the art, especially in light of the detailed disclosure provided herein.

For any preparation used in the methods of the invention, the therapeutically effective amount or dose can be estimated initially from in vitro and cell culture assays. For example, a dose can be formulated in animal models to achieve a desired concentration or titer. Such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition. (See e.g., Fingl, et al., 1975, in "The Pharmacological Basis of Therapeutics", Ch. 1 p. 1).

Dosage amount and interval may be adjusted individually to provide levels of the active ingredient are sufficient to induce or suppress the biological effect (minimal effective concentration, MEC). The MEC will vary for each preparation, but can be estimated from in vitro data. Dosages necessary to achieve the MEC will depend on individual characteristics and route of administration. Detection assays can be used to determine plasma concentrations.

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc.

Compositions of the present invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert. Compositions comprising a preparation of the invention formulated in a compatible pharmaceutical carrier may also be prepared, placed in an appropriate container, and labeled for treatment of an indicated condition, as is further detailed above.

According to an aspect of some embodiments of the invention, there is provided a method of selecting a drug for treating a typical relapsing remitting multiple sclerosis (RRMS) in a subject, the method is effected by (a) contacting cells of a subject classified as having a typical RRMS with a plurality of drug molecules, (b) identifying at least one drug molecule which downregulates a level of expression of at least one gene involved in the RNA polymerase I pathway, the at least one drug molecule is suitable for treating the typical RRMS in the subject, thereby selecting the drug for treating the typical RRMS in the subject.

The plurality of drug molecules can be peptides, RNA, DNA, aptamers and small molecules.

According to some embodiments of the invention the polynucleotides described hereinabove (e.g., oligonucleotides) can form a part of a probeset.

According to some embodiments of the invention, the probeset comprises a plurality of oligonucleotides and no more than 50 oligonucleotides (e.g., no more than about 40, no more than about 30, e.g., no more than about 20, e.g., no more than about 15, e.g., no more than about 10 oligonucleotides) wherein an oligonucleotide of the plurality of oligonucleotides specifically recognizes a polynucleotide of at least one gene involved in the RNA polymerase pathway. For example, each of the oligonucleotides can specifically recognize a polynucleotide of the RNA polymerase I pathway.

According to some embodiments of the invention the probeset comprises a plurality of oligonucleotides and no more than 500 oligonucleotides wherein each of the plurality of oligonucleotides is capable of specifically recognizing at least one polynucleotide sequence selected from the group consisting of C22orf8, TLK1, HNRPH1, PLXDC1, TLK1, PKN2, ALS2CR8, FLJ12547, ZNF238, PDPR, NT5E, PASK, HPGD, IL6ST, JARID1A, PASK, LEF1, FLJ10246, MTUS1, FLJ14011, VSIG4, MARCH-VI, FLJ10613, EWSR1, ATP8A1, SLC4A7, FLJ21127, HNRPH1, ABLIM1, ITGA6, ADCY9, CROCC, SH3YL1, SMA4, SPTBN1, DPEP3, PDE3B, AF5Q31, NRCAM, DOCK9, IPW, FLJ20152, SIRPB2, GALNT4, CD28, TXK, ETS1, DGCR5, ZNF192, TCF7, CAMK4, SIM2, MGEA5, TGFBR2, RET, MAPK8IP3, RRN3, DKFZp547H025, FBXW11, ZNF423, DLG1, MGC17330, CD164L1, REPS1, ACHE, ITGB1BP2, LOC94431, LTK, RUNX1, EVER1, KIAA2010, CEACAM7, STX16, SLC4A5, CRTAP, RECQL5, MAGEF1, VIPR1, FLJ10979, TTC3, CRSP2, BAZ2A, GTF2I, MGC50853, KIAA0508, BPHL, LTBP4, FN3KRP, SCARB1, MGC17330, HYAL4, DGKA, FLJ11196, DHRS6, EPHB4, IDI2/GTPBP4, SNTG2, SLC7A6, PMS2L2, KIAA0436, TOSO, THRAP3, T3JAM, LOC283232, LOC92482, PTER, ATM, NUCB2, PIK3R2, MGC1136, CD59, JARID1A, FLJ39616, ABLIM1, PBP, MAPK8IP3, FTS, LHX5, TNFRSF7, MYC, PBXIP1, DATF1, HTF9C, PUS1, KIAA0924, C6orf4, KIAA0372, WDR42A, CRYZL1, TERE1, LTBP4, TTC3, NFATC1, POM121/LOC340318, TOSO, LOC348926/MGC16279/SB153/FLJ10661, SPOCK2, KIAA0515, SLC37A4, CD44, SMARCA2, SPTBN1, C6orf130, TTC3, DLG1, SLC35E2, MCCC1, PMS2L11, RCN3, STX16, FLJ20618, STAT5B, SMARCA2, SATB1, POLR1D, ASXL1, REV1L, PMS2L2/PMS2L5, FLJ12355, CCNB1IP1, FLJ12270, KIAA0692, MCM7, GPSN2, STX16, MMS19L, GTF2I/GTF2IP1, AKAP7, ZNF444, SLC35A3, MGEA5, RUTBC3, C20orf36, RAD17, ALG12, LOC112869, C6orf48, CUTC, LGTN, DEF6, WAC, HNRPH3, NS, KIAA0892, LRPPRC, HMG20A, DDX42, TINP1, ZDHHC17, C19orf2, EIF4B, LOC376745, DKFZP434C171, TH1L, C19orf13, RPL22, PHF15, EWSR1, EIF4B, FAM48A, YT521, NEK9, EIF3S7, RPS6, RPL35A, EEF2, RPL3, RPS6, UBA52, RPL6, RPS6, RPL13, AL353949, AL580863, AF052160, AW128846, AW974481, N92920, BG178274, AW303460, BF057458, AL050035, M59917, AK025422, AI693985, AU158442, AK021460, AL023773, NM_003790, AC005011, M90355, AL353580, U38964, D50683, BE967207, YWHAB, ATP6V1E1, UBB, MRLC2/MRCL3, UQCR, MRLC2, RTN4, UBE2A, RTN4, WDR1, PSMA6, C14orf123, PP1201, TBK1, CAST, CAST, RSN, PSME1, SDF2, GSTO1, CAST, DNCL1, SQRDL, ADIPOR2, ICMT, NDUFA6, NDUFA6, COX17, HIF1AN, FLJ20257, TBPL1, RAPGEF2, CRSP8, APOL1, PAOX, CNDP2, ETFA, DPP3, KPNA1, MGC3036, TUBB2, PDCL, CCL5, CDS2, RAP1GDS1, ATP6V1D, OBRGRP/LEPR, SF4, GCLC, MGST3, BICD2, BRF1, CHST12, EXOSC7, TOR1B, ZFP95, ILK, UNC13A, MTHFD2, CASP10, FLJ45850, CMRF-35H, ARF3, NDOR1, DUSP10, AP1M2, VRK2, GSN, PTRF, RBM19, RABGAP1L, ATP5S, STOM, TFPI2, SLCO3A1, PTPN12, CSF1, SIGLEC6, KIRREL, OBRGRP, TP53AP1, SUHW1, NUP98, IL15RA, MICB, CMRF-35H, SPHK1, TNFRSF6, FLJ11301, LRP5, STOM, EPHA2, SRC, FLJ11301, PSTPIP2, EBP, MCPH1, PTPRF, LIMK2, FSTL4, CBR1, MGC2654, MYCT1, NOL3, MITF, ATP10B, FBXO31, TBX21, LSS, SLC17A3, MNAB, CHPPR, GIF, VAMPS, ABCG2, KIF1B, LOH11CR2A, NID2, RBBP8, ETV7, CTSL, RUFY1, RSU1, PARD3, APOB, ACOX3, DAB2, LDLR, TJP2, GNAS, PARD3, NCKAP1, TAP2, HDGFRP3, LDLR, PIK3R3, HTR2B, GAS2L1, FER1L3, C3orf14, TP53TG3, LEPR, CLIC5, PDE4DIP, ATP9A, ITGB1BP1, INDO, SELP, FHL2, FER1L3, EGF, SIAT8A, HDGFRP3, LRAP, VWF, FLJ10134, IMP-3, DMN, MCTP1, FSTL1, CTNNAL1, RAB27B, THBS1, PROS1, MMRN1, CTTN, AL078596, AI148659, U00956 and M29383.

It will be appreciated that the isolated nucleic acid sequences included in the kit or the probeset of the present invention can be bound to a solid support e.g., a glass wafer in a specific order, i.e., in the form of a microarray. Alternatively, isolated nucleic acid sequences can be synthesized directly on the solid support using well known prior art approaches (Seo T S, et al., 2004, Proc. Natl. Acad. Sci. USA, 101: 5488-93.). In any case, the isolated nucleic acid sequences are attached to the support in a location specific manner such that each specific isolated nucleic acid sequence has a specific address on the support (i.e., an addressable location) which denotes the identity (i.e., the sequence) of that specific isolated nucleic acid sequence.

The kit may further include a positive control for an expression level of at least one of the polynucleotides of the invention (e.g., which involves in the RNA polymerase I pathway). The positive control can be any biological sample derived from a reference subject (i.e., a subject with a known course of MS, i.e., BMS or typical RRMS), a biological sample with known amount/concentration of the gene product (i.e., RNA or protein) of at least one of the polynucleotides of the invention; or a pre-determined level (amount/concentration) of purified, chemically synthesized or recombinantly generated RNA or protein molecules (gene products) of the at least one polynucleotide of the invention. The kit may further comprise instructions for use in classifying a subject as being more like to have BMS or typical RRMS, to diagnose BMS or typical RRMS, to monitor treatment efficiency, to select a treatment regimen, to treat a subject having multiple sclerosis and/or to select for drugs suitable for treating multiple sclerosis.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Materials and Experimental Methods

Subjects—

31 patients (age 44.5±1.5; female to male ratio 24:7) with BMS were characterized by mean EDSS 1.95±0.15, disease duration 17.0±1.3 years, annual EDSS rate 0.13±0.01, annual relapse rate 0.23±0.04. 36 patients (age 40.3±1.8; female to male ratio 8:3) with typical RRMS were characterized by mean EDSS 3.54±0.23, disease duration 10.9±1.4 years, annual EDSS rate 0.45±0.06, annual relapse rate 0.64±0.09.

RNA Isolation and Microarray Expression Profiling—

Peripheral blood mononuclear cells (PBMC) were separated on ficoll-hypaque gradient. Total RNA was isolated using the TRIzol Reagent (Invitrogen, Carlsbad, Calif.), and cDNA was synthesized, labeled and hybridized to HG-U133A-2 array (Affymetrix, Inc, Santa Clara, Calif.) containing 22,215 gene-transcripts, washed and scanned (Hewlett Packard, GeneArray-TM scanner G2500A) according to manufacturer's protocol Affymetrix (Inc, Santa Clara, Calif.).

Data Analysis—

Data analysis was performed using the Partek Genomics Solution software [World Wide Web (dot) partek (dot) com]. Expression values were computed from raw CEL (cell) files by applying the Robust Multi-Chip Average (RMA) background correction algorithm. The RMA correction included: 1) values background correction; 2) quantile normalization; 3) log 2 transformation; 4) median polish summarization. In order to avoid the noise caused by variable set effects each set was normalized to pre-saved distribution pattern of a well balanced set used as a reference distribution. To reduce batch effect ANOVA multiple model analysis was applied. Source of variation was analyzed; nuisance batches effects such as working batch, patient age, gender and treatment were eliminated. Most informative genes (MIGs) were defined as genes with $p<0.01$ by ANOVA linear contrasts model. For samples classification, principal component analyses (PCA) were performed.

Gene functional annotation, enrichment and pathway analysis were performed using functional classification tools, David Bioinformatics Resources [Hypertext Transfer Protocol://david (dot) abcc (dot) nciferf (dot) gov/home (dot) jsp], and Ingenuity Pathways Analysis web-software [World Wide Web (dot) ingenuity (dot) com]. Enrichment was defined as significantly ($p<0.05$) higher proportion of genes in a given gene set than expected by chance analysis. The study design is demonstrated in FIG. 1.

Example 1

Experimental Results

Identification of Differentiating Genes Between Patients with BMS and Patients with Typical RRMS—

Figure 2:
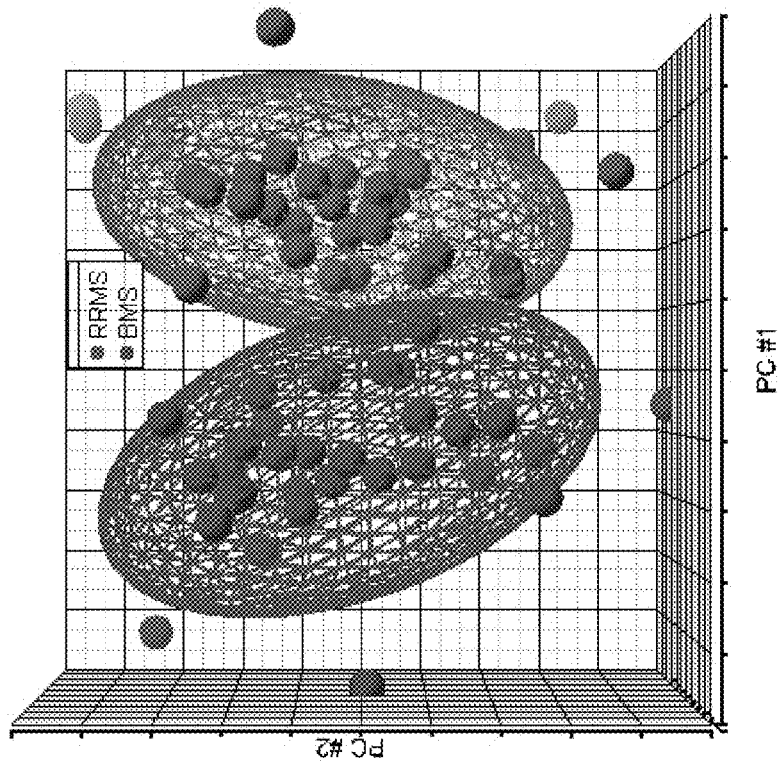
FIG. 2 depicts Principal Component Analysis (PCA) based on 406 most informative genes (MIGs)

BMS patients differentiated from typical RRMS by 406 MIGs (most informative genes), 171 genes were over-expressed (upregulated) and 235 were down-expressed (downregulated), with the log fold change ranged from −3.1 to 3.3 (FIG. 2).

Table 1 hereinbelow provides the differentiating genes between BMS and typical RRMS patients.

TABLE 1

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 216683_at | 1 | AL353949 | 407 | 6.85E−04 | −1.129 | — | — |
| 219629_at | 2 | NM_017911 | 408 | 5.51E−03 | −1.117 | C22orf8 | chromosome 22 open reading frame 8 |
| 210379_s_at | 3 | AI469203 | 409 | 7.42E−03 | −1.083 | TLK1 | tousled-like kinase 1 |
| 213472_at | 4 | AI022387 | 410 | 4.25E−03 | −1.081 | HNRPH1 | heterogeneous nuclear ribonucleoprotein H1 (H) |
| 219700_at | 5 | NM_020405 | 411 | 5.56E−05 | −1.081 | PLXDC1 | plexin domain containing 1 |
| 211077_s_at | 6 | Z25421 | 412 | 9.89E−04 | −1.080 | TLK1 | tousled-like kinase 1 /// tousled-like kinase 1 |
| 210969_at | 7 | AF118089 | 413 | 4.20E−04 | −1.078 | PKN2 | protein kinase N2 |
| 216298_at | 8 | AL580863 | 414 | 3.57E−03 | −1.075 | — | Similar to T-cell receptor gamma chain V region PT-gamma-1/2 precursor /// Simil |
| 219834_at | 9 | NM_024744 | 415 | 1.20E−03 | −1.069 | ALS2CR8 | amyotrophic lateral sclerosis 2 (juvenile) chromosome region, candidate 8 |
| 215262_at | 10 | AF052160 | 416 | 2.29E−04 | −1.068 | — | Clone 24629 mRNA sequence |
| 220715_at | 11 | NM_024992 | 417 | 1.53E−04 | −1.067 | FLJ12547 | hypothetical protein FLJ12547 |
| 207164_s_at | 12 | NM_006352 | 418 | 4.17E−03 | −1.067 | ZNF238 | zinc finger protein 238 |
| 220236_at | 13 | NM_017990 | 419 | 7.14E−04 | −1.067 | PDPR | pyruvate dehydrogenase phosphatase regulatory subunit |
| 203939_at | 14 | NM_002526 | 420 | 1.84E−03 | −1.065 | NT5E | 5′-nucleotidase, ecto (CD73) |
| 216945_x_at | 15 | U79240 | 421 | 2.45E−03 | −1.063 | PASK | PAS domain containing serine/threonine kinase |
| 203913_s_at | 16 | NM_000860 | 422 | 4.09E−03 | −1.062 | HPGD | hydroxyprostaglandin dehydrogenase 15-(NAD) |
| 204864_s_at | 17 | BE856546 | 423 | 9.98E−03 | −1.060 | IL6ST | interleukin 6 signal transducer (gp130, oncostatin M receptor) |
| 215698_at | 18 | AF007135 | 424 | 3.73E−03 | −1.057 | JARID1A | Jumonji, AT rich interactive domain 1A (RBBP2-like) |
| 213534_s_at | 19 | D50925 | 425 | 3.86E−03 | −1.056 | PASK | PAS domain containing serine/threonine kinase |
| 210948_s_at | 20 | AF294627 | 426 | 1.98E−03 | −1.056 | LEF1 | lymphoid enhancer-binding factor 1 |
| 220458_at | 21 | NM_018038 | 427 | 8.30E−03 | −1.055 | FLJ10246 | hypothetical protein FLJ10246 |
| 212093_s_at | 22 | AI695017 | 428 | 8.37E−03 | −1.052 | MTUS1 | mitochondrial tumor suppressor 1 |
| 207120_at | 23 | NM_022103 | 429 | 1.75E−03 | −1.050 | FLJ14011 | hypothetical zinc finger protein FLJ14011 |
| 204787_at | 24 | NM_007268 | 430 | 3.61E−03 | −1.050 | VSIG4 | V-set and immunoglobulin domain containing 4 |
| 215512_at | 25 | AK000970 | 431 | 1.74E−03 | −1.049 | MARCH-VI | membrane-associated RING-CH protein VI |
| 46947_at | 26 | T87245 | 432 | 1.23E−03 | −1.049 | FLJ10613 | Hypothetical protein FLJ10613 |

TABLE 1-continued

Genes which are differentially expressed in blood samples of benign multiple sclerosis
(BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 210012_s_at | 27 | BC000527 | 433 | 7.10E−03 | −1.048 | EWSR1 | Ewing sarcoma breakpoint region 1 |
| 210192_at | 28 | AB013452 | 434 | 7.32E−03 | −1.048 | ATP8A1 | ATPase, aminophospholipid transporter (APLT), Class I, type 8A, member 1 |
| 207603_at | 29 | NM_003615 | 435 | 2.30E−03 | −1.047 | SLC4A7 | solute carrier family 4, sodium bicarbonate cotransporter, member 7 |
| 218584_at | 30 | NM_024549 | 436 | 7.79E−03 | −1.047 | FLJ21127 | hypothetical protein FLJ21127 |
| 213470_s_at | 31 | BF983406 | 437 | 8.91E−03 | −1.047 | HNRPH1 | heterogeneous nuclear ribonucleoprotein H1 (H) |
| 210461_s_at | 32 | BC002448 | 438 | 1.63E−03 | −1.047 | ABLIM1 | actin binding LIM protein 1 |
| 217656_at | 33 | AW128846 | 439 | 5.27E−04 | −1.045 | — |  |
| 215177_s_at | 34 | AV733308 | 440 | 4.01E−04 | −1.045 | ITGA6 | integrin, alpha 6 |
| 204498_s_at | 35 | NM_001116 | 441 | 3.72E−04 | −1.043 | ADCY9 | adenylate cyclase 9 |
| 216419_at | 36 | AK026910 | 442 | 7.82E−03 | −1.043 | CROCC | ciliary rootlet coiled-coil, rootletin |
| 204019_s_at | 37 | NM_015677 | 443 | 1.11E−03 | −1.043 | SH3YL1 | SH3 domain containing, Ysc84-like 1 (*S. cerevisiae*) |
| 214850_at | 38 | X75940 | 444 | 4.48E−03 | −1.043 | SMA4 | SMA4 |
| 200672_x_at | 39 | NM_003128 | 445 | 1.59E−03 | −1.043 | SPTBN1 | spectrin, beta, non-erythrocytic 1 |
| 220179_at | 40 | NM_022357 | 446 | 1.40E−03 | −1.042 | DPEP3 | dipeptidase 3 |
| 208591_s_at | 41 | NM_000922 | 447 | 6.54E−05 | −1.042 | PDE3B | phosphodiesterase 3B, cGMP-inhibited |
| 219199_at | 42 | NM_014423 | 448 | 5.72E−03 | −1.042 | AF5Q31 | ALL1 fused gene from 5q31 |
| 216959_x_at | 43 | U55258 | 449 | 1.65E−03 | −1.041 | NRCAM | neuronal cell adhesion molecule |
| 215041_s_at | 44 | BE259050 | 450 | 6.36E−03 | −1.040 | DOCK9 | dedicator of cytokinesis 9 |
| 213447_at | 45 | AI672541 | 451 | 5.32E−05 | −1.040 | IPW | imprinted in Prader-Willi syndrome |
| 218532_s_at | 46 | NM_019000 | 452 | 4.80E−03 | −1.040 | FLJ20152 | hypothetical protein FLJ20152 |
| 220485_s_at | 47 | NM_018556 | 453 | 1.56E−03 | −1.039 | SIRPB2 | signal-regulatory protein beta 2 |
| 220442_at | 48 | NM_003774 | 454 | 8.94E−03 | −1.039 | GALNT4 | UDP-N-acetyl-alpha-D-galactosamine: polypeptide N-acetylgalactosaminyltransferase |
| 211856_x_at | 49 | AF222341 | 455 | 9.84E−03 | −1.039 | CD28 | CD28 antigen (Tp44) |
| 206828_at | 50 | NM_003328 | 456 | 1.62E−03 | −1.039 | TXK | TXK tyrosine kinase |
| 214447_at | 51 | NM_005238 | 457 | 3.28E−03 | −1.038 | ETS1 | v-ets erythroblastosis virus E26 oncogene homolog 1 (avian) |
| 215244_at | 52 | AI479306 | 458 | 6.97E−03 | −1.038 | DGCR5 | DiGeorge syndrome critical region gene 5 (non-coding) |
| 206579_at | 53 | NM_006298 | 459 | 5.64E−03 | −1.038 | ZNF192 | zinc finger protein 192 |
| 205254_x_at | 54 | AW027359 | 460 | 3.05E−03 | −1.038 | TCF7 | transcription factor 7 (T-cell specific, HMG-box) |
| 210349_at | 55 | L24959 | 461 | 3.07E−03 | −1.037 | CAMK4 | calcium/calmodulin-dependent protein kinase IV |

TABLE 1-continued

Genes which are differentially expressed in blood samples of benign multiple sclerosis
(BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 208157_at | 56 | NM_009586 | 462 | 9.47E−03 | −1.037 | SIM2 | single-minded homolog 2 (Drosophila) |
| 214972_at | 57 | AU144791 | 463 | 4.25E−03 | −1.037 | MGEA5 | Meningioma expressed antigen 5 (hyaluronidase) |
| 207334_s_at | 58 | NM_003242 | 464 | 2.70E−03 | −1.037 | TGFBR2 | transforming growth factor, beta receptor II (70/80 kDa) |
| 217666_at | 59 | AW974481 | 465 | 1.06E−03 | −1.037 | — | — |
| 215771_x_at | 60 | X15786 | 466 | 1.14E−03 | −1.036 | RET | ret proto-oncogene (multiple endocrine neoplasia and medullary thyroid carcinoma |
| 216139_s_at | 61 | AL031718 | 467 | 7.40E−03 | −1.036 | MAPK8IP3 | mitogen-activated protein kinase 8 interacting protein 3 |
| 216902_s_at | 62 | AF001549 | 468 | 4.86E−05 | −1.036 | RRN3 | RRN3 RNA polymerase I transcription factor homolog (yeast) |
| 208265_at | 63 | NM_020161 | 469 | 6.06E−04 | −1.036 | DKFZp547H025 | hypothetical protein DKFZp547H025 |
| 209456_s_at | 64 | AB033281 | 470 | 3.49E−03 | −1.036 | FBXW11 | F-box and WD-40 domain protein 11 |
| 217237_at | 65 | Y10615 | 471 | 7.72E−03 | −1.035 | ZNF423 | Zinc finger protein 423 |
| 217208_s_at | 66 | AL121981 | 472 | 2.91E−03 | −1.035 | DLG1 | discs, large homolog 1 (Drosophila) |
| 221757_at | 67 | BE042976 | 473 | 1.83E−04 | −1.035 | MGC17330 | HGFL gene /// HGFL gene |
| 213481_at | 68 | N92920 | 474 | 4.47E−03 | −1.035 | — | — |
| 219025_at | 69 | NM_020404 | 475 | 2.84E−03 | −1.035 | CD164L1 | CD164 sialomucin-like 1 |
| 215201_at | 70 | AW166925 | 476 | 9.15E−03 | −1.034 | REPS1 | RALBP1 associated Eps domain containing 1 |
| 205378_s_at | 71 | NM_015831 | 477 | 6.79E−03 | −1.034 | ACHE | acetylcholinesterase (YT blood group) |
| 219829_at | 72 | NM_012278 | 478 | 6.24E−03 | −1.033 | ITGB1BP2 | integrin beta 1 binding protein (melusin) 2 |
| 216908_x_at | 73 | AF001549 | 468 | 6.22E−04 | −1.033 | LOC94431 | similar to RNA polymerase I transcription factor RRN3 |
| 217184_s_at | 74 | X52213 | 479 | 4.40E−03 | −1.033 | LTK | leukocyte tyrosine kinase |
| 211181_x_at | 75 | AF312386 | 480 | 4.63E−03 | −1.033 | RUNX1 | runt-related transcription factor 1 (acute myeloid leukemia 1; aml1 oncogene) |
| 214958_s_at | 76 | AK021738 | 481 | 1.62E−03 | −1.033 | EVER1 | epidermodysplasia verruciformis 1 |
| 220369_at | 77 | NM_017936 | 482 | 7.90E−03 | −1.033 | KIAA2010 | KIAA2010 |
| 211848_s_at | 78 | AF006623 | 483 | 8.77E−04 | −1.033 | CEACAM7 | carcinoembryonic antigen-related cell adhesion molecule 7 |
| 221638_s_at | 79 | AF008937 | 484 | 8.81E−03 | −1.033 | STX16 | syntaxin 16 |
| 221723_s_at | 80 | AF243499 | 485 | 8.08E−03 | −1.033 | SLC4A5 | solute carrier family 4, sodium bicarbonate cotransporter, member 5 |
| 201380_at | 81 | NM_006371 | 486 | 8.45E−04 | −1.032 | CRTAP | cartilage associated protein |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 34063_at | 82 | AB006533 | 487 | 1.03E−03 | −1.032 | RECQL5 | RecQ protein-like 5 |
| 214757_at | 83 | BG178274 | 488 | 5.20E−03 | −1.032 | — | Hypothetical gene supported by AK024602 |
| 218176_at | 84 | NM_022149 | 489 | 4.04E−03 | −1.032 | MAGEF1 | melanoma antigen, family F, 1 |
| 221977_at | 85 | AW303460 | 490 | 7.35E−03 | −1.032 | — | — |
| 214161_at | 86 | BF057458 | 491 | 9.56E−03 | −1.031 | — | — |
| 214857_at | 87 | AL050035 | 492 | 6.21E−03 | −1.031 | — | MRNA; cDNA DKFZp566H0124 (from clone DKFZp566H0124) |
| 216230_x_at | 88 | M59917 | 493 | 1.74E−03 | −1.031 | — | — |
| 205019_s_at | 89 | NM_004624 | 494 | 3.56E−03 | −1.031 | VIPR1 | vasoactive intestinal peptide receptor 1 |
| 221707_s_at | 90 | BC006116 | 495 | 7.60E−03 | −1.031 | FLJ10979 | hypothetical protein FLJ10979 /// hypothetical protein FLJ10979 |
| 208664_s_at | 91 | AU131711 | 496 | 1.15E−04 | −1.030 | TTC3 | tetratricopeptide repeat domain 3 |
| 215167_at | 92 | BE567032 | 497 | 8.69E−03 | −1.030 | CRSP2 | cofactor required for Sp1 transcriptional activation, subunit 2, 150 kDa |
| 215437_x_at | 93 | BE513659 | 498 | 4.06E−03 | −1.030 | BAZ2A | bromodomain adjacent to zinc finger domain, 2A |
| 210892_s_at | 94 | BC004472 | 499 | 3.77E−03 | −1.029 | GTF2I | general transcription factor II, i |
| 212400_at | 95 | AL043266 | 500 | 1.57E−03 | −1.029 | MGC50853 | hypothetical protein MGC50853 |
| 215137_at | 96 | H92070 | 501 | 5.46E−03 | −1.029 | KIAA0508 | KIAA0508 protein |
| 205750_at | 97 | NM_004332 | 502 | 1.95E−03 | −1.028 | BPHL | biphenyl hydrolase-like (serine hydrolase; breast epithelial mucin-associated an |
| 210628_x_at | 98 | AF051344 | 503 | 1.93E−03 | −1.028 | LTBP4 | latent transforming growth factor beta binding protein 4 |
| 218210_at | 99 | NM_024619 | 504 | 1.42E−03 | −1.028 | FN3KRP | fructosamine-3-kinase-related protein |
| 216784_at | 100 | AK025422 | 505 | 2.68E−03 | −1.028 | — | Transcribed locus, weakly similar to XP_375174.1 hypothetical gene supported by |
| 201819_at | 101 | NM_005505 | 506 | 7.48E−03 | −1.028 | SCARB1 | scavenger receptor class B, member 1 |
| 214312_at | 102 | AI693985 | 507 | 2.93E−03 | −1.028 | — | — |
| 215556_at | 103 | AU158442 | 508 | 3.90E−03 | −1.028 | — | — |
| 221756_at | 104 | BE042976 | 473 | 2.52E−03 | −1.027 | MGC17330 | HGFL gene /// HGFL gene |
| 216909_at | 105 | AK021460 | 509 | 5.34E−03 | −1.027 | — | — |
| 220249_at | 106 | NM_012269 | 510 | 8.17E−03 | −1.027 | HYAL4 | hyaluronoglucosaminidase 4 |
| 211272_s_at | 107 | AF064771 | 511 | 3.46E−03 | −1.027 | DGKA | diacylglycerol kinase, alpha 80 kDa |
| 218651_s_at | 108 | NM_018357 | 512 | 7.30E−03 | −1.027 | FLJ11196 | acheron |
| 218285_s_at | 109 | NM_020139 | 513 | 2.93E−03 | −1.027 | DHRS6 | dehydrogenase/reductase (SDR family) member 6 |
| 217385_at | 110 | AL023773 | 514 | 2.79E−03 | −1.027 | — | — |
| 202894_at | 111 | NM_004444 | 515 | 1.52E−03 | −1.026 | EPHB4 | EPH receptor B4 |
| 217631_at | 112 | AI081107 | 516 | 6.97E−03 | −1.026 | IDI2 /// GTPBP4 | isopentenyl-diphosphate delta isomerase 2 /// GTP binding protein 4 |

TABLE 1-continued

Genes which are differentially expressed in blood samples of benign multiple sclerosis
(BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 220487_at | 113 | NM_018968 | 517 | 9.34E−03 | −1.026 | SNTG2 | syntrophin, gamma 2 |
| 203579_s_at | 114 | AI660619 | 518 | 1.98E−03 | −1.026 | SLC7A6 | solute carrier family 7 (cationic amino acid transporter, y+ system), member 6 |
| 215412_x_at | 115 | AB017007 | 519 | 7.10E−04 | −1.026 | PMS2L2 | postmeiotic segregation increased 2-like 2 |
| 212217_at | 116 | AU154782 | 520 | 1.32E−03 | −1.026 | KIAA0436 | putative prolyl oligopeptidase |
| 221602_s_at | 117 | AI084226 | 521 | 3.58E−04 | −1.026 | TOSO | regulator of Fas-induced apoptosis /// regulator of Fas-induced apoptosis |
| 217847_s_at | 118 | NM_005119 | 522 | 8.43E−03 | −1.025 | THRAP3 | thyroid hormone receptor associated protein 3 |
| 215275_at | 119 | AW963138 | 523 | 9.31E−03 | −1.025 | T3JAM | TRAF3-interacting Jun N-terminal kinase (JNK)-activating modulator |
| 221951_at | 120 | AI739035 | 524 | 2.65E−03 | −1.025 | LOC283232 | hypothetical protein LOC283232 |
| 213224_s_at | 121 | AK025724 | 525 | 7.84E−05 | −1.024 | LOC92482 | Hypothetical protein LOC92482 |
| 218967_s_at | 122 | BF112019 | 526 | 5.08E−03 | −1.024 | PTER | phosphotriesterase related |
| 208442_s_at | 123 | NM_000051 | 527 | 9.87E−04 | −1.024 | ATM | ataxia telangiectasia mutated (includes complementation groups A, C and D) |
| 203675_at | 124 | NM_005013 | 528 | 5.38E−03 | −1.024 | NUCB2 | nucleobindin 2 |
| 207105_s_at | 125 | NM_005027 | 529 | 2.15E−03 | −1.023 | PIK3R2 | phosphoinositide-3-kinase, regulatory subunit 2 (p85 beta) |
| 219144_at | 126 | NM_024025 | 530 | 3.23E−03 | −1.023 | MGC1136 | hypothetical protein MGC1136 |
| 212463_at | 127 | BE379006 | 531 | 9.58E−03 | −1.023 | CD59 | CD59 antigen p18-20 (antigen identified by monoclonal antibodies 16.3A5, EJ16, E |
| 202040_s_at | 128 | NM_005056 | 532 | 8.73E−03 | −1.023 | JARID1A | Jumonji, AT rich interactive domain 1A (RBBP2-like) |
| 64432_at | 129 | W05463 | 533 | 4.53E−03 | −1.023 | FLJ39616 | apoptosis related protein PNAS-1 |
| 200965_s_at | 130 | NM_006720 | 534 | 2.98E−03 | −1.022 | ABLIM1 | actin binding LIM protein 1 |
| 205353_s_at | 131 | NM_002567 | 535 | 9.67E−03 | −1.022 | PBP | prostatic binding protein |
| 213177_at | 132 | AB028989 | 536 | 9.13E−03 | −1.022 | MAPK8IP3 | mitogen-activated protein kinase 8 interacting protein 3 |
| 218373_at | 133 | NM_022476 | 537 | 6.35E−03 | −1.022 | FTS | fused toes homolog (mouse) |
| 208333_at | 134 | NM_022363 | 538 | 4.11E−03 | −1.022 | LHX5 | LIM homeobox 5 |
| 206150_at | 135 | NM_001242 | 539 | 8.17E−03 | −1.022 | TNFRSF7 | tumor necrosis factor receptor superfamily, member 7 /// tumor necrosis factor r |
| 202431_s_at | 136 | NM_002467 | 540 | 7.39E−03 | −1.022 | MYC | v-myc myelocytomatosis viral oncogene homolog (avian) |
| 207838_x_at | 137 | NM_020524 | 541 | 3.63E−03 | −1.021 | PBXIP1 | pre-B-cell leukemia transcription factor interacting protein 1 |

TABLE 1-continued

Genes which are differentially expressed in blood samples of benign multiple sclerosis
(BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 218325_s_at | 138 | NM_022105 | 542 | 1.46E−03 | −1.021 | DATF1 | death associated transcription factor 1 |
| 218475_at | 139 | NM_022727 | 543 | 1.53E−03 | −1.021 | HTF9C | HpaII tiny fragments locus 9C |
| 218670_at | 140 | NM_025215 | 544 | 1.05E−03 | −1.021 | PUS1 | pseudouridylate synthase 1 |
| 205594_at | 141 | NM_014897 | 545 | 8.79E−03 | −1.021 | KIAA0924 | KIAA0924 protein |
| 215411_s_at | 142 | AL008730 | 546 | 7.21E−03 | −1.021 | C6orf4 | chromosome 6 open reading frame 4 |
| 203048_s_at | 143 | NM_014639 | 547 | 2.14E−03 | −1.020 | KIAA0372 | KIAA0372 |
| 216885_s_at | 144 | AK026481 | 548 | 4.07E−04 | −1.020 | WDR42A | WD repeat domain 42A |
| 219767_s_at | 145 | NM_005111 | 549 | 3.79E−03 | −1.020 | CRYZL1 | crystallin, zeta (quinone reductase)-like 1 |
| 219131_at | 146 | NM_013319 | 550 | 3.21E−03 | −1.020 | TERE1 | transitional epithelia response protein |
| 213176_s_at | 147 | AI910869 | 551 | 6.21E−03 | −1.020 | LTBP4 | latent transforming growth factor beta binding protein 4 |
| 208661_s_at | 148 | D84294 | 552 | 4.85E−03 | −1.020 | TTC3 | tetratricopeptide repeat domain 3 |
| 208196_x_at | 149 | NM_006162 | 553 | 9.44E−03 | −1.020 | NFATC1 | nuclear factor of activated T-cells, cytoplasmic, calcineurin-dependent 1 |
| 212178_s_at | 150 | AK022555 | 554 | 2.95E−03 | −1.020 | POM121 /// LOC340318 | POM121 membrane glycoprotein (rat) /// hypothetical protein LOC340318 |
| 221601_s_at | 151 | AI084226 | 521 | 2.54E−03 | −1.020 | TOSO | regulator of Fas-induced apoptosis /// regulator of Fas-induced apoptosis |
| 222013_x_at | 152 | BE348837 | 555 | 5.16E−03 | −1.019 | LOC348926 /// MGC16279 /// SB153 /// FLJ10661 | hypothetical protein LOC348926 /// hypothetical protein MGC16279 /// hypothetica |
| 202524_s_at | 153 | AI952009 | 556 | 5.43E−03 | −1.019 | SPOCK2 | sparc/osteonectin, cwcv and kazal-like domains proteoglycan (testican) 2 |
| 212068_s_at | 154 | AB011087 | 557 | 9.23E−03 | −1.019 | KIAA0515 | KIAA0515 |
| 202830_s_at | 155 | NM_001467 | 558 | 5.82E−03 | −1.019 | SLC37A4 | solute carrier family 37 (glycerol-6-phosphate transporter), member 4 |
| 209835_x_at | 156 | BC004372 | 559 | 5.79E−03 | −1.019 | CD44 | CD44 antigen (homing function and Indian blood group system) |
| 212257_s_at | 157 | AW131754 | 560 | 1.51E−03 | −1.019 | SMARCA2 | SWI/SNF related, matrix associated, actin dependent regulator of chromatin, subf |
| 212071_s_at | 158 | BE968833 | 561 | 2.68E−03 | −1.019 | SPTBN1 | spectrin, beta, non-erythrocytic 1 |
| 213322_at | 159 | AL031778 | 562 | 8.31E−04 | −1.019 | C6orf130 | chromosome 6 open reading frame 130 |
| 210645_s_at | 160 | D83077 | 563 | 2.20E−03 | −1.019 | TTC3 | tetratricopeptide repeat domain 3 |
| 202514_at | 161 | AW139131 | 564 | 4.70E−03 | −1.018 | DLG1 | DKFZP586B0319 protein |
| 217122_s_at | 162 | AL031282 | 565 | 4.05E−03 | −1.018 | SLC35E2 | solute carrier family 35, member E2 |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 218440_at | 163 | NM_020166 | 566 | 9.21E−05 | −1.018 | MCCC1 | methylcrotonoyl-Coenzyme A carboxylase 1 (alpha) |
| 210707_x_at | 164 | U38980 | 567 | 3.76E−04 | −1.018 | PMS2L11 | postmeiotic segregation increased 2-like 11 |
| 61734_at | 165 | AI797684 | 568 | 3.19E−03 | −1.018 | RCN3 | reticulocalbin 3, EF-hand calcium binding domain |
| 221500_s_at | 166 | AK026970 | 569 | 1.50E−04 | −1.018 | STX16 | syntaxin 16 |
| 219422_at | 167 | NM_0003790 | 570 | 6.24E−03 | −1.018 | — | — |
| 222244_s_at | 168 | AK000749 | 571 | 5.14E−03 | −1.018 | FLJ20618 | hypothetical protein FLJ20618 |
| 212550_at | 169 | AI149535 | 572 | 1.46E−03 | −1.018 | STAT5B | signal transducer and activator of transcription 5B |
| 206544_x_at | 170 | NM_003070 | 573 | 5.64E−03 | −1.018 | SMARCA2 | SWI/SNF related, matrix associated, actin dependent regulator of chromatin, subf |
| 216380_x_at | 171 | AC005011 | 574 | 3.97E−03 | −1.018 | — | — |
| 203408_s_at | 172 | NM_002971 | 575 | 6.31E−03 | −1.018 | SATB1 | special AT-rich sequence binding protein 1 (binds to nuclear matrix/scaffold-ass |
| 218258_at | 173 | NM_015972 | 576 | 2.71E−03 | −1.017 | POLR1D | polymerase (RNA) I polypeptide D, 16 kDa |
| 212234_at | 174 | AL034550 | 577 | 5.94E−03 | −1.017 | ASXL1 | additional sex combs like 1 (*Drosophila*) |
| 217461_x_at | 175 | M90355 | 578 | 7.56E−03 | −1.017 | — | — |
| 218428_s_at | 176 | NM_016316 | 579 | 8.87E−03 | −1.017 | REV1L | REV1-like (yeast) |
| 215667_x_at | 177 | AI375694 | 580 | 1.00E−03 | −1.017 | PMS2L2 /// PMS2L5 | postmeiotic segregation increased 2-like 2 /// postmeiotic segregation increased |
| 220465_at | 178 | NM_024988 | 581 | 2.08E−03 | −1.017 | FLJ12355 | hypothetical protein FLJ12355 |
| 217988_at | 179 | NM_021178 | 582 | 9.05E−03 | −1.017 | CCNB1IP1 | cyclin B1 interacting protein 1 |
| 221981_s_at | 180 | AA702154 | 583 | 3.45E−03 | −1.017 | FLJ12270 | hypothetical protein FLJ12270 |
| 212201_at | 181 | AW274877 | 584 | 5.96E−03 | −1.017 | KIAA0692 | KIAA0692 protein |
| 208795_s_at | 182 | D55716 | 585 | 1.81E−03 | −1.017 | MCM7 | MCM7 minichromosome maintenance deficient 7 (*S. cerevisiae*) |
| 208336_s_at | 183 | NM_004868 | 586 | 5.33E−03 | −1.017 | GPSN2 | glycoprotein, synaptic 2 |
| 221499_s_at | 184 | AK026970 | 569 | 8.49E−03 | −1.017 | STX16 | syntaxin 16 |
| 202167_s_at | 185 | NM_022362 | 587 | 8.82E−03 | −1.017 | MMS19L | MMS19-like (MET18 homolog, *S. cerevisiae*) |
| 201065_s_at | 186 | NM_001518 | 588 | 4.02E−03 | −1.017 | GTF2I /// GTF2IP1 | general transcription factor II, i /// general transcription factor II, i, pseud |
| 211172_x_at | 187 | AF161075 | 589 | 2.00E−03 | −1.017 | AKAP7 | A kinase (PRKA) anchor protein 7 |
| 218707_at | 188 | NM_018337 | 590 | 7.16E−03 | −1.016 | ZNF444 | zinc finger protein 444 |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 206770_s_at | 189 | NM_012243 | 591 | 9.43E−03 | −1.016 | SLC35A3 | solute carrier family 35 (UDP-N-acetylglucosamine (UDP-GlcNAc) transporter), mem |
| 200898_s_at | 190 | AK002091 | 592 | 2.97E−03 | −1.016 | MGEA5 | meningioma expressed antigen 5 (hyaluronidase) |
| 215519_x_at | 191 | AI081779 | 593 | 3.72E−03 | −1.016 | RUTBC3 | RUN and TBC1 domain containing 3 |
| 212406_s_at | 192 | AB028973 | 594 | 4.48E−03 | −1.016 | C20orf36 | chromosome 20 open reading frame 36 |
| 210826_x_at | 193 | AF098533 | 595 | 4.28E−03 | −1.015 | RAD17 | RAD17 homolog (*S. pombe*) |
| 218444_at | 194 | NM_024105 | 596 | 6.99E−03 | −1.015 | ALG12 | asparagine-linked glycosylation 12 homolog (yeast, alpha-1,6-mannosyltransferase |
| 221822_at | 195 | BE544663 | 597 | 4.91E−03 | −1.015 | LOC112869 | hypothetical protein BC011981 |
| 220755_s_at | 196 | NM_016947 | 598 | 7.95E−04 | −1.015 | C6orf48 | chromosome 6 open reading frame 48 |
| 218970_s_at | 197 | NM_015960 | 599 | 9.75E−03 | −1.015 | CUTC | cutC copper transporter homolog (*E. coli*) |
| 218253_s_at | 198 | NM_006893 | 600 | 5.75E−03 | −1.015 | LGTN | ligatin |
| 221293_s_at | 199 | NM_022047 | 601 | 2.42E−03 | −1.015 | DEF6 | differentially expressed in FDCP 6 homolog (mouse) |
| 217742_s_at | 200 | NM_016628 | 602 | 5.14E−03 | −1.015 | WAC | WW domain containing adaptor with coiled-coil |
| 207127_s_at | 201 | NM_021644 | 603 | 4.06E−03 | −1.014 | HNRPH3 | heterogeneous nuclear ribonucleoprotein H3 (2H9) |
| 217850_at | 202 | NM_014366 | 604 | 5.81E−03 | −1.014 | NS | nucleostemin |
| 212505_s_at | 203 | AL110250 | 605 | 8.73E−03 | −1.014 | KIAA0892 | KIAA0892 |
| 211971_s_at | 204 | AI653608 | 606 | 2.30E−05 | −1.014 | LRPPRC | leucine-rich PPR-motif containing |
| 216387_x_at | 205 | AL353580 | 607 | 5.15E−03 | −1.014 | — | — |
| 218152_at | 206 | NM_018200 | 608 | 8.22E−03 | −1.014 | HMG20A | high-mobility group 20A |
| 201788_at | 207 | NM_007372 | 609 | 4.77E−03 | −1.014 | DDX42 | DEAD (Asp-Glu-Ala-Asp) box polypeptide 42 |
| 201922_at | 208 | NM_014886 | 610 | 6.30E−03 | −1.014 | TINP1 | TGF beta-inducible nuclear protein 1 |
| 212982_at | 209 | AI621223 | 611 | 4.57E−03 | −1.014 | ZDHHC17 | zinc finger, DHHC domain containing 17 |
| 214173_x_at | 210 | AW514900 | 612 | 2.20E−04 | −1.014 | C19orf2 | chromosome 19 open reading frame 2 |
| 211937_at | 211 | NM_001417 | 613 | 3.24E−03 | −1.014 | EIF4B | eukaryotic translation initiation factor 4B |
| 216843_x_at | 212 | U38964 | 614 | 6.22E−03 | −1.014 | — | — |
| 212854_x_at | 213 | AB051480 | 615 | 1.60E−03 | −1.013 | LOC376745 | AG1 |
| 212886_at | 214 | AL080169 | 616 | 4.76E−03 | −1.013 | DKFZP434C171 | DKFZP434C171 protein |
| 220607_x_at | 215 | NM_016397 | 617 | 3.15E−03 | −1.012 | TH1L | TH1-like (*Drosophila*) |
| 212132_at | 216 | AL117499 | 618 | 5.52E−04 | −1.011 | C19orf13 | chromosome 19 open reading frame 13 |
| 214042_s_at | 217 | AW071997 | 619 | 3.11E−03 | −1.011 | RPL22 | ribosomal protein L22 |
| 212660_at | 218 | AI735639 | 620 | 5.22E−03 | −1.011 | PHF15 | PHD finger protein 15 |
| 208944_at | 219 | D50683 | 621 | 5.54E−03 | −1.011 | — | — |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 210011_s_at | 220 | BC000527 | 433 | 9.77E−03 | −1.010 | EWSR1 | Ewing sarcoma breakpoint region 1 |
| 211938_at | 221 | BF247371 | 622 | 8.55E−03 | −1.010 | EIF4B | eukaryotic translation initiation factor 4B |
| 220408_x_at | 222 | NM_017569 | 623 | 6.06E−03 | −1.010 | FAM48A | family with sequence similarity 48, member A |
| 212114_at | 223 | BE967207 | 624 | 9.73E−03 | −1.010 | — | Similar to microtubule-associated proteins 1A/1B light chain 3 |
| 212455_at | 224 | N36997 | 625 | 2.91E−03 | −1.009 | YT521 | splicing factor YT521-B |
| 212299_at | 225 | AL117502 | 626 | 6.14E−03 | −1.009 | NEK9 | NIMA (never in mitosis gene a)-related kinase 9 |
| 200005_at | 226 | NM_003753 | 627 | 4.23E−03 | −1.008 | EIF3S7 | eukaryotic translation initiation factor 3, subunit 7 zeta, 66/67 kDa /// eukaryo |
| 200081_s_at | 227 | BE741754 | 628 | 1.02E−03 | −1.007 | RPS6 | ribosomal protein S6 /// ribosomal protein S6 |
| 213687_s_at | 228 | BE968801 | 629 | 8.26E−03 | −1.006 | RPL35A | ribosomal protein L35a |
| 204102_s_at | 229 | NM_001961 | 630 | 5.59E−03 | −1.006 | EEF2 | eukaryotic translation elongation factor 2 |
| 211666_x_at | 230 | L22453 | 631 | 6.17E−03 | −1.006 | RPL3 | ribosomal protein L3 /// ribosomal protein L3 |
| 209134_s_at | 231 | BC000524 | 632 | 1.77E−03 | −1.005 | RPS6 | ribosomal protein S6 |
| 221700_s_at | 232 | AF348700 | 633 | 2.98E−04 | −1.005 | UBA52 | ubiquitin A-52 residue ribosomal protein fusion product 1 /// ubiquitin A-52 res |
| 200034_s_at | 233 | NM_000970 | 634 | 9.34E−03 | −1.005 | RPL6 | ribosomal protein L6 /// ribosomal protein L6 |
| 201254_x_at | 234 | NM_001010 | 635 | 7.37E−03 | −1.004 | RPS6 | ribosomal protein S6 |
| 212734_x_at | 235 | AI186735 | 636 | 8.06E−03 | −1.003 | RPL13 | ribosomal protein L13 |
| 217718_s_at | 236 | NM_014052 | 637 | 6.36E−03 | 1.005 | YWHAB | tyrosine 3-monooxygenase/tryptophan 5-monooxygenase activation protein, beta pol |
| 208678_at | 237 | BC004443 | 638 | 8.57E−03 | 1.006 | ATP6V1E1 | ATPase, H+ transporting, lysosomal 31 kDa, V1 subunit E isoform 1 |
| 200633_at | 238 | NM_018955 | 639 | 2.94E−03 | 1.006 | UBB | ubiquitin B /// ubiquitin B |
| 201318_s_at | 239 | NM_006471 | 640 | 1.52E−03 | 1.007 | MRLC2 /// MRCL3 | myosin regulatory light chain MRLC2 /// myosin regulatory light chain MRCL3 |
| 202090_s_at | 240 | NM_006830 | 641 | 3.41E−03 | 1.008 | UQCR | ubiquinol-cytochrome c reductase (6.4 kD) subunit |
| 221474_at | 241 | U26162 | 642 | 7.75E−03 | 1.008 | MRLC2 | myosin regulatory light chain MRLC2 |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 214629_x_at | 242 | AF320999 | 643 | 3.29E−03 | 1.009 | RTN4 | reticulon 4 |
| 200067_x_at | 243 | AL078596 | 644 | 9.11E−03 | 1.010 | — | — |
| 201899_s_at | 244 | NM_003336 | 645 | 8.17E−03 | 1.010 | UBE2A | ubiquitin-conjugating enzyme E2A (RAD6 homolog) |
| 210968_s_at | 245 | AF333336 | 646 | 3.86E−03 | 1.010 | RTN4 | reticulon 4 |
| 200609_s_at | 246 | NM_017491 | 647 | 5.41E−04 | 1.010 | WDR1 | WD repeat domain 1 |
| 208805_at | 247 | BC002979 | 648 | 3.97E−03 | 1.011 | PSMA6 | proteasome (prosome, macropain) subunit, alpha type, 6 |
| 218571_s_at | 248 | NM_014169 | 649 | 5.41E−03 | 1.011 | C14orf123 | chromosome 14 open reading frame 123 |
| 217730_at | 249 | NM_022152 | 650 | 5.26E−03 | 1.013 | PP1201 | PP1201 protein |
| 218520_at | 250 | NM_013254 | 651 | 9.23E−03 | 1.013 | TBK1 | TANK-binding kinase 1 |
| 208908_s_at | 251 | AF327443 | 652 | 7.99E−03 | 1.014 | CAST | calpastatin |
| 207467_x_at | 252 | NM_001750 | 653 | 8.54E−03 | 1.014 | CAST | calpastatin |
| 201975_at | 253 | NM_002956 | 654 | 5.39E−03 | 1.015 | RSN | restin (Reed-Steinberg cell-expressed intermediate filament-associated protein) |
| 200814_at | 254 | NM_006263 | 655 | 2.49E−04 | 1.015 | PSME1 | proteasome (prosome, macropain) activator subunit 1 (PA28 alpha) |
| 203090_at | 255 | NM_006923 | 656 | 4.45E−03 | 1.015 | SDF2 | stromal cell-derived factor 2 |
| 201470_at | 256 | NM_004832 | 657 | 2.35E−03 | 1.015 | GSTO1 | glutathione S-transferase omega 1 |
| 212586_at | 257 | AA195244 | 658 | 6.42E−03 | 1.016 | CAST | calpastatin |
| 200703_at | 258 | NM_003746 | 659 | 5.88E−03 | 1.016 | DNCL1 | dynein, cytoplasmic, light polypeptide 1 |
| 217995_at | 259 | NM_021199 | 660 | 9.02E−03 | 1.016 | SQRDL | sulfide quinone reductase-like (yeast) |
| 201346_at | 260 | NM_024551 | 661 | 3.81E−03 | 1.016 | ADIPOR2 | adiponectin receptor 2 |
| 201609_x_at | 261 | AL578502 | 662 | 1.36E−03 | 1.016 | ICMT | isoprenylcysteine carboxyl methyltransferase |
| 202000_at | 262 | BC002772 | 663 | 6.15E−03 | 1.016 | NDUFA6 | NADH dehydrogenase (ubiquinone) 1 alpha subcomplex, 6, 14 kDa |
| 202001_s_at | 263 | BC002772 | 663 | 7.78E−03 | 1.017 | NDUFA6 | NADH dehydrogenase (ubiquinone) 1 alpha subcomplex, 6, 14 kDa |
| 203880_at | 264 | NM_005694 | 664 | 6.24E−03 | 1.017 | COX17 | COX17 homolog, cytochrome c oxidase assembly protein (yeast) |
| 218525_s_at | 265 | NM_017902 | 665 | 9.42E−03 | 1.017 | HIF1AN | hypoxia-inducible factor 1, alpha subunit inhibitor |
| 219798_s_at | 266 | NM_019606 | 666 | 3.38E−03 | 1.017 | FLJ20257 | hypothetical protein FLJ20257 |
| 208398_s_at | 267 | NM_004865 | 667 | 7.76E−03 | 1.017 | TBPL1 | TBP-like 1 |
| 218358_at | 268 | NM_024324 | 668 | 6.57E−03 | 1.017 | — | — |
| 203097_s_at | 269 | NM_014247 | 669 | 4.66E−03 | 1.017 | RAPGEF2 | Rap guanine nucleotide exchange factor (GEF) 2 |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 221598_s_at | 270 | BC002878 | 670 | 7.63E−03 | 1.017 | CRSP8 | cofactor required for Sp1 transcriptional activation, subunit 8, 34 kDa |
| 209546_s_at | 271 | AF323540 | 671 | 6.71E−03 | 1.018 | APOL1 | apolipoprotein L, 1 |
| 50400_at | 272 | AI743990 | 672 | 7.35E−03 | 1.018 | PAOX | polyamine oxidase (exo-N4-amino) |
| 217752_s_at | 273 | NM_018235 | 673 | 4.11E−03 | 1.018 | CNDP2 | CNDP dipeptidase 2 (metallopeptidase M20 family) |
| 201931_at | 274 | NM_000126 | 674 | 6.90E−03 | 1.018 | ETFA | electron-transfer-flavoprotein, alpha polypeptide (glutaric aciduria II) |
| 218567_x_at | 275 | NM_005700 | 675 | 1.00E−02 | 1.019 | DPP3 | dipeptidylpeptidase 3 |
| 202056_at | 276 | AW051311 | 676 | 8.93E−03 | 1.019 | KPNA1 | Karyopherin alpha 1 (importin alpha 5) |
| 218907_s_at | 277 | NM_023942 | 677 | 2.62E−03 | 1.019 | MGC3036 | hypothetical protein MGC3036 |
| 213726_x_at | 278 | AA515698 | 678 | 2.22E−03 | 1.019 | TUBB2 | tubulin, beta, 2 |
| 204448_s_at | 279 | AF031463 | 679 | 7.00E−03 | 1.019 | PDCL | phosducin-like |
| 1405_i_at | 280 | M21121 | 680 | 9.54E−03 | 1.019 | CCL5 | chemokine (C-C motif) ligand 5 |
| 212864_at | 281 | Y16521 | 681 | 9.17E−03 | 1.019 | CDS2 | CDP-diacylglycerol synthase (phosphatidate cytidylyltransferase) 2 |
| 209444_at | 282 | BC001851 | 682 | 1.27E−04 | 1.019 | RAP1GDS1 | RAP1, GTP-GDP dissociation stimulator 1 |
| 208898_at | 283 | AF077614 | 683 | 2.37E−03 | 1.019 | ATP6V1D | ATPase, H+ transporting, lysosomal 34 kDa, V1 subunit D |
| 202377_at | 284 | AW026535 | 684 | 5.30E−03 | 1.019 | OBRGRP /// LEPR | leptin receptor gene-related protein /// leptin receptor |
| 209547_s_at | 285 | BC001043 | 685 | 4.14E−03 | 1.020 | SF4 | splicing factor 4 |
| 202922_at | 286 | BF676980 | 686 | 4.19E−03 | 1.020 | GCLC | glutamate-cysteine ligase, catalytic subunit |
| 201403_s_at | 287 | NM_004528 | 687 | 3.64E−03 | 1.020 | MGST3 | microsomal glutathione S-transferase 3 |
| 213154_s_at | 288 | AI934125 | 688 | 2.75E−03 | 1.020 | BICD2 | bicaudal D homolog 2 (*Drosophila*) |
| 215676_at | 289 | N91109 | 689 | 8.42E−03 | 1.021 | BRF1 | BRF1 homolog, subunit of RNA polymerase III transcription initiation factor IIIB |
| 218927_s_at | 290 | BC002918 | 690 | 8.09E−03 | 1.021 | CHST12 | carbohydrate (chondroitin 4) sulfotransferase 12 |
| 213648_at | 291 | AW614427 | 691 | 6.11E−03 | 1.021 | EXOSC7 | Exosome component 7 |
| 209593_s_at | 292 | AF317129 | 692 | 8.82E−03 | 1.021 | TOR1B | torsin family 1, member B (torsin B) |
| 203731_s_at | 293 | NM_014569 | 693 | 1.78E−03 | 1.022 | ZFP95 | zinc finger protein 95 homolog (mouse) |
| 201234_at | 294 | NM_004517 | 694 | 2.90E−03 | 1.022 | ILK | integrin-linked kinase |
| 214817_at | 295 | BE783668 | 695 | 8.61E−03 | 1.022 | UNC13A | unc-13 homolog A (*C. elegans*) |
| 201761_at | 296 | NM_006636 | 696 | 3.83E−03 | 1.022 | MTHFD2 | methylene tetrahydrofolate dehydrogenase (NAD+ dependent), methenyltetrahydrofol |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 205467_at | 297 | NM_001230 | 697 | 6.50E-03 | 1.022 | CASP10 | caspase 10, apoptosis-related cysteine protease |
| 222318_at | 298 | AI744673 | 698 | 9.20E-03 | 1.022 | FLJ45850 | FLJ45850 protein |
| 209933_s_at | 299 | AF020314 | 699 | 6.24E-03 | 1.022 | CMRF-35H | leukocyte membrane antigen |
| 200734_s_at | 300 | BG341906 | 700 | 4.33E-03 | 1.023 | ARF3 | ADP-ribosylation factor 3 |
| 219899_x_at | 301 | NM_014434 | 701 | 7.97E-03 | 1.023 | NDOR1 | NADPH dependent diflavin oxidoreductase 1 |
| 221563_at | 302 | N36770 | 702 | 3.41E-03 | 1.024 | DUSP10 | dual specificity phosphatase 10 |
| 65517_at | 303 | AA910946 | 703 | 4.00E-03 | 1.024 | AP1M2 | adaptor-related protein complex 1, mu 2 subunit |
| 205126_at | 304 | NM_006296 | 704 | 8.89E-03 | 1.024 | VRK2 | vaccinia related kinase 2 |
| 200696_s_at | 305 | NM_000177 | 705 | 8.30E-03 | 1.024 | GSN | gelsolin (amyloidosis, Finnish type) |
| 208790_s_at | 306 | AF312393 | 706 | 4.43E-03 | 1.025 | PTRF | polymerase I and transcript release factor |
| 205115_s_at | 307 | NM_016196 | 707 | 8.06E-03 | 1.025 | RBM19 | RNA binding motif protein 19 |
| 213982_s_at | 308 | BG107203 | 708 | 8.15E-03 | 1.025 | RABGAP1L | RAB GTPase activating protein 1-like |
| 206992_s_at | 309 | NM_015684 | 709 | 2.03E-03 | 1.025 | ATP5S | ATP synthase, H+ transporting, mitochondrial F0 complex, subunit s (factor B) |
| 201060_x_at | 310 | AI537887 | 710 | 9.12E-04 | 1.025 | STOM | stomatin |
| 209278_s_at | 311 | L27624 | 711 | 7.18E-03 | 1.026 | TFPI2 | tissue factor pathway inhibitor 2 |
| 210542_s_at | 312 | BC000585 | 712 | 4.38E-03 | 1.026 | SLCO3A1 | solute carrier organic anion transporter family, member 3A1 |
| 202006_at | 313 | NM_002835 | 713 | 3.01E-03 | 1.026 | PTPN12 | protein tyrosine phosphatase, non-receptor type 12 |
| 210557_x_at | 314 | M76453 | 714 | 2.04E-03 | 1.026 | CSF1 | colony stimulating factor 1 (macrophage) |
| 210796_x_at | 315 | D86359 | 715 | 2.95E-03 | 1.027 | SIGLEC6 | sialic acid binding Ig-like lectin 6 |
| 220825_s_at | 316 | NM_018240 | 716 | 9.74E-03 | 1.027 | KIRREL | kin of IRRE like (Drosophila) |
| 202378_s_at | 317 | NM_017526 | 717 | 2.72E-03 | 1.027 | OBRGRP | leptin receptor gene-related protein |
| 210241_s_at | 318 | AB007458 | 718 | 3.02E-03 | 1.027 | TP53AP1 | TP53 activated protein 1 |
| 213069_at | 319 | AI148659 | 719 | 2.90E-03 | 1.027 | — | — |
| 216034_at | 320 | AA558468 | 720 | 9.90E-03 | 1.027 | SUHW1 | suppressor of hairy wing homolog 1 (Drosophila) |
| 210793_s_at | 321 | U41815 | 721 | 2.64E-03 | 1.029 | NUP98 | nucleoporin 98 kDa |
| 207375_s_at | 322 | NM_002189 | 722 | 3.71E-03 | 1.029 | IL15RA | interleukin 15 receptor, alpha |
| 206247_at | 323 | NM_005931 | 723 | 2.70E-03 | 1.029 | MICB | MHC class I polypeptide-related sequence B |
| 217078_s_at | 324 | AJ010102 | 724 | 9.65E-03 | 1.029 | CMRF-35H | leukocyte membrane antigen |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 219257_s_at | 325 | NM_021972 | 725 | 1.62E−03 | 1.030 | SPHK1 | sphingosine kinase 1 |
| 204781_s_at | 326 | NM_000043 | 726 | 8.44E−03 | 1.030 | TNFRSF6 | tumor necrosis factor receptor superfamily, member 6 |
| 221536_s_at | 327 | AL136897 | 727 | 2.28E−03 | 1.030 | FLJ11301 | hypothetical protein FLJ11301 |
| 209468_at | 328 | AB017498 | 728 | 8.91E−03 | 1.030 | LRP5 | low density lipoprotein receptor-related protein 5 |
| 201061_s_at | 329 | M81635 | 729 | 1.46E−04 | 1.030 | STOM | stomatin |
| 203499_at | 330 | NM_004431 | 730 | 6.49E−03 | 1.031 | EPHA2 | EPH receptor A2 |
| 213324_at | 331 | AK024281 | 731 | 7.63E−03 | 1.031 | SRC | v-src sarcoma (Schmidt-Ruppin A-2) viral oncogene homolog (avian) |
| 221535_at | 332 | AL136897 | 727 | 3.81E−03 | 1.031 | FLJ11301 | hypothetical protein FLJ11301 |
| 219938_at | 333 | NM_024430 | 732 | 3.19E−03 | 1.032 | PSTPIP2 | proline-serine-threonine phosphatase interacting protein 2 |
| 213787_s_at | 334 | AV702405 | 733 | 1.78E−03 | 1.032 | EBP | emopamil binding protein (sterol isomerase) |
| 219592_at | 335 | NM_024596 | 734 | 8.43E−03 | 1.032 | MCPH1 | microcephaly, primary autosomal recessive 1 |
| 200637_s_at | 336 | AI762627 | 735 | 5.52E−03 | 1.033 | PTPRF | protein tyrosine phosphatase, receptor type, F |
| 202193_at | 337 | NM_005569 | 736 | 4.88E−03 | 1.033 | LIMK2 | LIM domain kinase 2 |
| 214859_at | 338 | AI635302 | 737 | 8.68E−03 | 1.034 | FSTL4 | follistatin-like 4 |
| 209213_at | 339 | BC002511 | 738 | 5.69E−03 | 1.034 | CBR1 | carbonyl reductase 1 |
| 218945_at | 340 | NM_024109 | 739 | 3.75E−03 | 1.034 | MGC2654 | hypothetical protein MGC2654 |
| 220471_s_at | 341 | NM_025107 | 740 | 8.29E−03 | 1.035 | MYCT1 | myc target 1 |
| 59625_at | 342 | AI912351 | 741 | 5.19E−03 | 1.035 | NOL3 | nucleolar protein 3 (apoptosis repressor with CARD domain) |
| 207233_s_at | 343 | NM_000248 | 742 | 2.93E−03 | 1.035 | MITF | microphthalmia-associated transcription factor |
| 214070_s_at | 344 | AW006935 | 743 | 5.14E−03 | 1.036 | ATP10B | ATPase, Class V, type 10B |
| 219785_s_at | 345 | NM_024735 | 744 | 5.84E−03 | 1.036 | FBXO31 | F-box protein 31 |
| 220684_at | 346 | NM_013351 | 745 | 3.34E−03 | 1.037 | TBX21 | T-box 21 |
| 202245_at | 347 | AW084510 | 746 | 7.02E−03 | 1.037 | LSS | lanosterol synthase (2,3-oxidosqualene-lanosterol cyclase) |
| 207298_at | 348 | NM_006632 | 747 | 6.68E−03 | 1.037 | SLC17A3 | solute carrier family 17 (sodium phosphate), member 3 |
| 220201_at | 349 | NM_018835 | 748 | 3.85E−03 | 1.038 | MNAB | membrane associated DNA binding protein |
| 203208_s_at | 350 | BF214329 | 749 | 6.89E−04 | 1.038 | CHPPR | likely ortholog of chicken chondrocyte protein with a poly-proline region |
| 207033_at | 351 | NM_005142 | 750 | 3.42E−04 | 1.039 | GIF | gastric intrinsic factor (vitamin B synthesis) |
| 204929_s_at | 352 | NM_006634 | 751 | 6.38E−03 | 1.039 | VAMP5 | vesicle-associated membrane protein 5 (myobrevin) |
| 209735_at | 353 | AF098951 | 752 | 7.05E−03 | 1.039 | ABCG2 | ATP-binding cassette, sub-family G (WHITE), member 2 |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 209234_at | 354 | BF939474 | 753 | 3.31E−04 | 1.039 | KIF1B | kinesin family member 1B |
| 210102_at | 355 | BC001234 | 754 | 5.97E−03 | 1.040 | LOH11CR2A | loss of heterozygosity, 11, chromosomal region 2, gene A |
| 204114_at | 356 | NM_007361 | 755 | 4.45E−03 | 1.041 | NID2 | nidogen 2 (osteonidogen) |
| 203344_s_at | 357 | NM_002894 | 756 | 1.33E−03 | 1.041 | RBBP8 | retinoblastoma binding protein 8 |
| 216891_at | 358 | U00956 | 757 | 5.03E−03 | 1.042 | — | — |
| 221680_s_at | 359 | AF147782 | 758 | 9.08E−03 | 1.042 | ETV7 | ets variant gene 7 (TEL2 oncogene) |
| 202087_s_at | 360 | NM_001912 | 759 | 3.63E−03 | 1.042 | CTSL | cathepsin L |
| 218243_at | 361 | NM_025158 | 760 | 6.62E−03 | 1.043 | RUFY1 | RUN and FYVE domain containing 1 |
| 201980_s_at | 362 | NM_012425 | 761 | 5.59E−03 | 1.044 | RSU1 | Ras suppressor protein 1 |
| 221280_s_at | 363 | NM_019619 | 762 | 4.65E−04 | 1.044 | PARD3 | par-3 partitioning defective 3 homolog (*C. elegans*) |
| 205108_s_at | 364 | NM_000384 | 763 | 2.36E−04 | 1.045 | APOB | apolipoprotein B (including Ag(x) antigen) |
| 204241_at | 365 | BF055171 | 764 | 6.95E−04 | 1.045 | ACOX3 | acyl-Coenzyme A oxidase 3, pristanoyl |
| 201278_at | 366 | N21202 | 765 | 2.71E−03 | 1.049 | DAB2 | Disabled homolog 2, mitogen-responsive phosphoprotein (*Drosophila*) |
| 202067_s_at | 367 | AI861942 | 766 | 1.95E−03 | 1.050 | LDLR | low density lipoprotein receptor (familial hypercholesterolemia) |
| 202085_at | 368 | NM_004817 | 767 | 3.10E−03 | 1.051 | TJP2 | tight junction protein 2 (zona occludens 2) |
| 214157_at | 369 | AA401492 | 768 | 4.90E−03 | 1.053 | GNAS | GNAS complex locus |
| 221526_x_at | 370 | AF196185 | 769 | 2.72E−03 | 1.053 | PARD3 | par-3 partitioning defective 3 homolog (*C. elegans*) |
| 207738_s_at | 371 | NM_013436 | 770 | 2.00E−03 | 1.054 | NCKAP1 | NCK-associated protein 1 |
| 204769_s_at | 372 | NM_000544 | 771 | 3.15E−03 | 1.054 | TAP2 | transporter 2, ATP-binding cassette, sub-family B (MDR/TAP) |
| 216693_x_at | 373 | AL133102 | 772 | 6.34E−03 | 1.055 | HDGFRP3 | hepatoma-derived growth factor, related protein 3 |
| 202068_s_at | 374 | NM_000527 | 773 | 5.72E−03 | 1.057 | LDLR | low density lipoprotein receptor (familial hypercholesterolemia) |
| 202743_at | 375 | BE622627 | 774 | 7.96E−04 | 1.061 | PIK3R3 | phosphoinositide-3-kinase, regulatory subunit 3 (p55, gamma) |
| 206638_at | 376 | NM_000867 | 775 | 7.47E−03 | 1.061 | HTR2B | 5-hydroxytryptamine (serotonin) receptor 2B |
| 31874_at | 377 | Y07846 | 776 | 2.32E−03 | 1.061 | GAS2L1 | growth arrest-specific 2 like 1 |
| 201798_s_at | 378 | NM_013451 | 777 | 5.01E−03 | 1.062 | FER1L3 | fer-1-like 3, myoferlin (*C. elegans*) |
| 219288_at | 379 | NM_020685 | 778 | 6.67E−04 | 1.063 | C3orf14 | chromosome 3 open reading frame 14 |
| 220167_s_at | 380 | NM_015369 | 779 | 5.44E−04 | 1.064 | TP53TG3 | TP53TG3 protein |

TABLE 1-continued

Genes which are differentially expressed in blood samples of benign multiple sclerosis (BMS) and typical relapsing-remitting multiple sclerosis (RRMS) subjects

| Affymetrix Probeset ID | SEQ ID NO: | Representative Public ID | SEQ ID NO: | p-value BMS vs. typical RRMS | Log Fold Change (BMS vs. typical RRMS) | Gene Symbol | Gene Title |
|---|---|---|---|---|---|---|---|
| 211354_s_at | 381 | U52913 | 780 | 1.67E-03 | 1.066 | LEPR | leptin receptor |
| 213317_at | 382 | AL049313 | 781 | 7.15E-03 | 1.067 | CLIC5 | Chloride intracellular channel 5 |
| 212390_at | 383 | AB007923 | 782 | 8.15E-03 | 1.070 | PDE4DIP | phosphodiesterase 4D interacting protein (myomegalin) |
| 212062_at | 384 | AB014511 | 783 | 8.65E-03 | 1.070 | ATP9A | ATPase, Class II, type 9A |
| 203337_x_at | 385 | NM_004763 | 784 | 6.03E-03 | 1.071 | ITGB1BP1 | integrin beta 1 binding protein 1 |
| 210029_at | 386 | M34455 | 785 | 5.97E-03 | 1.073 | INDO | indoleamine-pyrrole 2,3 dioxygenase |
| 206049_at | 387 | NM_003005 | 786 | 8.60E-03 | 1.074 | SELP | selectin P (granule membrane protein 140 kDa, antigen CD62) |
| 202949_s_at | 388 | NM_001450 | 787 | 6.99E-03 | 1.076 | FHL2 | four and a half LIM domains 2 |
| 211864_s_at | 389 | AF207990 | 788 | 7.27E-03 | 1.076 | FER1L3 | fer-1-like 3, myoferlin (C. elegans) |
| 206254_at | 390 | NM_001963 | 789 | 5.83E-03 | 1.077 | EGF | epidermal growth factor (beta-urogastrone) |
| 210073_at | 391 | L32867 | 790 | 5.66E-04 | 1.077 | SIAT8A | sialyltransferase 8A (alpha-N-acetylneuraminate: alpha-2,8-sialyltransferase, GD |
| 209524_at | 392 | AK001280 | 791 | 1.03E-03 | 1.080 | HDGFRP3 | hepatoma-derived growth factor, related protein 3 |
| 219759_at | 393 | NM_022350 | 792 | 8.03E-04 | 1.081 | LRAP | leukocyte-derived arginine aminopeptidase |
| 202112_at | 394 | NM_000552 | 793 | 1.22E-03 | 1.082 | VWF | von Willebrand factor |
| 219410_at | 395 | NM_018004 | 794 | 4.81E-03 | 1.083 | FLJ10134 | hypothetical protein FLJ10134 |
| 203819_s_at | 396 | AU160004 | 795 | 3.58E-03 | 1.088 | IMP-3 | IGF-II mRNA-binding protein 3 |
| 212730_at | 397 | AK026420 | 796 | 3.19E-03 | 1.090 | DMN | desmuslin |
| 220122_at | 398 | NM_024717 | 797 | 5.82E-03 | 1.090 | MCTP1 | multiple C2-domains with two transmembrane regions 1 |
| 208782_at | 399 | BC000055 | 798 | 2.14E-03 | 1.095 | FSTL1 | follistatin-like 1 |
| 202468_s_at | 400 | NM_003798 | 799 | 1.36E-03 | 1.096 | CTNNAL1 | catenin (cadherin-associated protein), alpha-like 1 |
| 207018_s_at | 401 | NM_004163 | 800 | 4.02E-03 | 1.101 | RAB27B | RAB27B, member RAS oncogene family |
| 210354_at | 402 | M29383 | 801 | 4.60E-03 | 1.102 | — | — |
| 201110_s_at | 403 | NM_003246 | 802 | 9.38E-03 | 1.111 | THBS1 | thrombospondin 1 |
| 207808_s_at | 404 | NM_000313 | 803 | 2.92E-03 | 1.114 | PROS1 | protein S (alpha) |
| 205612_at | 405 | NM_007351 | 804 | 7.97E-03 | 1.118 | MMRN1 | multimerin 1 |
| 214073_at | 406 | BG475299 | 805 | 2.37E-03 | 1.121 | CTTN | cortactin |

Presented are the 406 differentiating genes given by the gene name and description, the Affymetrix probeset identification number, and a representative GenBank Accession number between BMS and typical RRMS patients. p-value - statistical significance by ANOVA; Log Fold Change = refers to the logarithms fold change between the expression level of a polynucleotide in a blood sample of a BMS subject as compared to the expression level in a blood sample of a typical RRMS subject: The (−) sign means that the polynucleotide is downregulated (decreased in level) in BMS as compared to typical RRMS subjects; and the (+) sign means that the polynucleotide is upregulated (increased in level) in BMS as compared to typical RRMS subjects.

Table 2 hereinbelow discloses additional polynucleotides (RNA alternative transcripts) of the above identified 406 genes which expression level is differentiating between typical RRMS and BMS.

TABLE 2

| PROBESET | SEQ ID NO: | Refseq Ids/SEQ ID NO: | | | | REFSEQ_UNIGENE | REFSEQ_BAND |
|---|---|---|---|---|---|---|---|
| 216683_at | 1 | —/— | | | | — | — |
| 219629_at | 2 | NM_017911/997 | | | | C22ORF8 | Hs.265018 |
| 210379_s_at | 3 | NM_012290/948 | | | | TLK1 | Hs.470586 |
| 213472_at | 4 | NM_020405/1022 | | | | PLXDC1 | Hs.125036 |
| 219700_at | 5 | NM_012290/948 | | | | TLK1 | Hs.470586 |
| 211077_s_at | 6 | NM_012290/948 | | | | TLK1 | Hs.470586 |
| 210969_at | 7 | —/— | | | | — | — |
| 216298_at | 8 | —/— | | | | — | — |
| 219834_at | 9 | NM_024744/1051 | | | | ALS2CR8 | Hs.444982 |
| 215262_at | 10 | —/— | | | | — | — |
| 220715_at | 11 | —/— | | | | — | — |
| 207164_s_at | 12 | NM_205768/1103 | NM_006352/1133 | | | ZNF238, ZNF238, PDPR | Hs.69997, Hs.69997, Hs.461183 |
| 220236_at | 13 | NM_017990/999 | | | | NT5E | Hs.153952 |
| 203939_at | 14 | NM_002526/865 | | | | PASK | Hs.397891 |
| 216945_x_at | 15 | NM_015148/970 | | | | HPGD | Hs.77348 |
| 203913_s_at | 16 | NM_000860/834 | | | | HPGD | Hs.77348 |
| 204864_s_at | 17 | NM_175767/1088 | NM_002183/1189 | | | IL6ST, IL6ST, | Hs.532082, Hs.532082, |
| 215698_at | 18 | —/— | | | | — | — |
| 213534_s_at | 19 | NM_015148/970 | | | | PASK | Hs.397891 |
| 210948_s_at | 20 | NM_016269/988 | | | | LEF1 | Hs.125132 |
| 220458_at | 21 | NM_018038/1001 | | | | FLJ10246 | Hs.274274 |
| 212093_s_at | 22 | NM_020749/1025 | NM_001001925/1114 | NM_001001924/1182 | NM_001001927/1216 | NM_001001931/1234 | MTUS1, MTUS1, MTUS1, MTUS1, MTUS1, FLJ14011 | Hs.7946, Hs.7946, Hs.7946, Hs.7946, Hs.7946, Hs.433473 |
| 207120_at | 23 | NM_022103/1033 | | | | VSIG4 | Hs.8904 |
| 204787_at | 24 | NM_007268/939 | | | | — | — |
| 215512_at | 25 | —/— | | | | — | — |
| 46947_at | 26 | —/— | | | | — | — |
| 210012_s_at | 27 | —/— | | | | — | — |

TABLE 2-continued

| PROBESET | SEQ ID NO: | Refseq Ids/SEQ ID NO: | | REFSEQ_UNIGENE | REFSEQ_BAND |
|---|---|---|---|---|---|
| 210192_at | 28 | NM_006095/ 918 | | ATP8A1 | Hs.435052 |
| 207603_at | 29 | —/— | | — | — |
| 218584_at | 30 | NM_024549/ 1047 | | FLJ21127 | Hs.211511 |
| 213470_s_at | 31 | NM_005520/ 912 | | HNRPH1 | Hs.202166 |
| 210461_s_at | 32 | NM_006720/ 930 | NM_001003407/ 1187 NM_001003408/ 1232 | ABLIM1, ABLIM1, ABLIM1, ABLIM1, | Hs.438236, Hs.438236, Hs.438236, Hs.438236, |
| 217656_at | 33 | —/— | | — | — |
| 215177_s_at | 34 | NM_000210/ 826 | | ITGA6 | Hs.133397 |
| 204498_s_at | 35 | NM_001116/ 848 | | ADCY9 | Hs.391860 |
| 216419_at | 36 | —/— | | — | — |
| 204019_s_at | 37 | NM_015677/ 979 | | SH3YL1 | Hs.515951 |
| 214850_at | 38 | NM_207331/ 1106 | | LOC153561 | Hs.545578 |
| 200672_x_at | 39 | NM_003128/ 872 | | SPTBN1 | Hs.503178 |
| 220179_at | 40 | NM_022357/ 1037 | | DPEP3 | Hs.302028 |
| 208591_s_at | 41 | NM_000922/ 835 | | PDE3B | Hs.445711 |
| 219199_at | 42 | NM_014423/ 958 | | AF5Q31 | Hs.519313 |
| 216959_x_at | 43 | NM_005010/ 899 | | NRCAM | Hs.21422 |
| 215041_s_at | 44 | NM_015296/ 973 | | DOCK9 | Hs.314413 |
| 213447_at | 45 | —/— | | — | — |
| 218532_s_at | 46 | NM_019000/ 1016 | | FLJ20152 | Hs.481704 |
| 220485_s_at | 47 | NM_018556/ 1011 | NM_080816/ 1150 | SIRPB2, SIRPB2, GALNT4 | Hs.50716, Hs.50716, Hs.534374 |
| 220442_at | 48 | NM_003774/ 881 | | | |
| 211856_x_at | 49 | NM_006139/ 919 | | CD28 | Hs.1987 |
| 206828_at | 50 | NM_003328/ 875 | | TXK | Hs.479669 |
| 214447_at | 51 | NM_005238/ 907 | | ETS1 | Hs.369438 |
| 215244_at | 52 | —/— | | — | — |
| 206579_at | 53 | NM_006298/ 922 | | ZNF192 | Hs.57679 |

TABLE 2-continued

| PROBESET | SEQ ID NO: | Refseq Ids/SEQ ID NO: | | | | REFSEQ_UNIGENE | REFSEQ_BAND |
|---|---|---|---|---|---|---|---|
| 205254_x_at | 54 | NM_201632/ 1099 | NM_201634/ 1173 | NM_213648/ 1215 | NM_003202/ 1219 | TCF7, TCF7, TCF7, TCF7, | Hs.519580, Hs.519580, Hs.519580, Hs.519580, |
| 210349_at | 55 | NM_001744/ 856 | | | | CAMK4 | Hs.220629 |
| 208157_at | 56 | NM_009586/ 942 | | | | SIM2 | Hs.146186 |
| 214972_at | 57 | — | | | | | |
| 207334_s_at | 58 | NM_003242/ 873 | | | | TGFBR2 | Hs.82028 |
| 217666_at | 59 | — | | | | | |
| 215771_x_at | 60 | NM_020975/ 1026 | | | | RET, RET, | Hs.350321, Hs.350321, |
| 216139_s_at | 61 | NM_033392/ 1057 | NM_020630/ 1143 | | | MAPK8IP3, MAPK8IP3, | Hs.207763, Hs.207763, |
| 216902_s_at | 62 | NM_018427/ 1010 | NM_015133/ 1138 | | | RRN3 | Hs.460078 |
| 208265_at | 63 | NM_020161/ 1019 | | | | DKFZP547H025 | Hs.283092 |
| 209456_s_at | 64 | NM_033645/ 1059 | NM_033644/ 1148 | | | FBXW11, FBXW11, FBXW11, | Hs.484138, Hs.484138, Hs.484138, |
| 217237_at | 65 | — | | | | | |
| 217208_s_at | 66 | NM_004087/ 885 | | | | DLG1 | Hs.292549 |
| 221757_at | 67 | NM_052880/ 1060 | | | | MGC17330 | Hs.26670 |
| 213481_at | 68 | — | | | | | |
| 219025_at | 69 | NM_020404/ 1021 | | | | CD164L1 | Hs.195727 |
| 215201_at | 70 | — | | | | | |
| 205378_at | 71 | NM_000665/ 833 | NM_015831/ 1139 | | | ACHE, ACHE, ITGB1BP2 | Hs.154495, Hs.154495, Hs.109999 |
| 219829_at | 72 | NM_012278/ 947 | | | | | |
| 216908_x_at | 73 | NM_018427/ 1010 | NM_145237/ 1156 | | | RRN3, LOC94431, | Hs.460078, Hs.546468, |
| 217184_s_at | 74 | NM_206961/ 1105 | NM_002344/ 1121 | | | LTK, LTK, | Hs.434481, Hs.434481, |
| 211181_x_at | 75 | NM_001001890/ 843 | NM_001754/ 1179 | | | RUNX1, RUNX1, EVER1 | Hs.149261, Hs.149261, Hs.16165 |
| 214958_s_at | 76 | NM_007267/ 938 | | | | KIAA2010 | Hs.533887 |
| 220369_at | 77 | NM_017936/ 998 | | | | | |
| 211848_s_at | 78 | NM_006890/ 932 | | | | CEACAM7 | Hs.74466 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 221638_s_at | 79 | NM_003763/ 880 | NM_001001434/ 842 | NM_001001433/ 1181 | STX16, STX16, STX16, | Hs.307913, Hs.307913, Hs.307913, |
| 221723_s_at | 80 | NM_021196/ 1028 | NM_133479/ 1152 | NM_133478/ 1201 | SLC4A5, SLC4A5, SLC4A5, | Hs.469033, Hs.469033, Hs.469033, |
| 201380_at | 81 | NM_006371/ 923 | | | CRTAP | Hs.517888 |
| 34063_at | 82 | NM_001003715/ 845 | NM_001003716/ 1178 | NM_004259/ 1191 | RECQL5, RECQL5, RECQL5, | Hs.514480, Hs.514480, Hs.514480, |
| 214757_at | 83 | —/— | | | — | — |
| 218176_at | 84 | NM_022149/ 1034 | | | MAGEF1 | Hs.306123 |
| 221977_at | 85 | —/— | | | — | — |
| 214161_at | 86 | —/— | | | — | — |
| 214857_at | 87 | —/— | | | — | — |
| 216230_x_at | 88 | NM_000543/ 829 | NM_001007593/ 1118 | | SMPD1, SMPD1, | Hs.498173, Hs.498173, |
| 205019_s_at | 89 | NM_004624/ 893 | | | VIPR1 | Hs.348500 |
| 221707_s_at | 90 | NM_018289/ 1006 | | | FLJ10979 | Hs.461819 |
| 208664_s_at | 91 | NM_001001894/ 844 | NM_003316/ 1180 | | TTC3, TTC3, | Hs.368214, Hs.368214, |
| 215167_at | 92 | —/— | | | — | — |
| 215437_x_at | 93 | NM_013449/ 955 | | | BAZ2A | Hs.314263 |
| 210892_s_at | 94 | NM_001518/ 854 | NM_033001/ 1146 | NM_033000/ 1198 | NM_032999/ 1222 | GTF2I, GTF2I, GTF2I, GTF2I, | Hs.520459, Hs.520459, Hs.520459, Hs.520459, |
| 212400_at | 95 | NM_203305/ 1101 | | | EEIG1 | Hs.460208 |
| 215137_at | 96 | —/— | | | — | — |
| 205750_at | 97 | NM_004332/ 888 | | | BPHL | Hs.10136 |
| 210628_x_at | 98 | NM_003573/ 877 | | | LTBP4 | Hs.466766 |
| 218210_at | 99 | NM_024619/ 1050 | | | FN3KRP | Hs.31431 |
| 216784_at | 100 | —/— | | | — | — |
| 201819_at | 101 | NM_005505/ 911 | | | SCARB1 | Hs.298813 |
| 214312_at | 102 | —/— | | | — | — |
| 215556_at | 103 | —/— | | | — | — |
| 221756_at | 104 | NM_052880/ 1060 | | | MGC17330 | Hs.26670 |
| 216909_at | 105 | —/— | | | — | — |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 220249_at | 106 | NM_012269/946 | | | HYAL4 | Hs.28673 |
| 211272_s_at | 107 | NM_201554/1098 | NM_201445/1119 | NM_201444/1229 | DGKA, DGKA, DGKA, DGKA, FLJ11196 | Hs.524488, Hs.524488, Hs.524488, Hs.524488, Hs.416755 |
| 218651_s_at | 108 | NM_018357/1008 | | | DHRS6 | Hs.124696 |
| 218285_s_at | 109 | NM_020139/1018 | | | — | — |
| 217385_at 202894_at | 110 111 | —/ NM_004444/890 | | | EPHB4 | Hs.437008 |
| 217631_at 220487_at | 112 113 | —/ NM_018968/1015 | | | SNTG2 | Hs.148819 |
| 203579_s_at | 114 | NM_003983/884 | | | SLC7A6 | Hs.351571 |
| 215412_x_at | 115 | NM_005395/908 | NM_001003686/1115 | NM_001003687/1183 | PMS2L3, PMS2L3, PMS2L3, PMS2L5, POM121, PMS2, | Hs.549057, Hs.549057, Hs.549057, Hs.397073, Hs.488624, Hs.487470, |
| 212217_at 221602_s_at | 116 117 | —/ NM_005449/909 | | | TOSO | Hs.58831 |
| 217847_s_at | 118 | NM_005119/905 | | | THRAP3 | Hs.160211 |
| 215275_at 221951_at | 119 120 | —/ NM_174940/1087 | NM_174930/1086 | NM_002679/867 | LOC283232 | Hs.448664 |
| 213224_s_at 218967_s_at | 121 122 | —/ NM_030664/1055 | NM_001001484/1113 | | PTER, PTER, ATM, ATM, | Hs.444321, Hs.444321, Hs.435561, Hs.435561, |
| 208442_s_at | 123 | NM_138292/1069 | NM_000051/1109 | | NUCB2 | Hs.128686 |
| 203675_at | 124 | NM_005013/900 | | | PIK3R2 | Hs.371344 |
| 207105_s_at | 125 | NM_005027/901 | | | MGC1136 | Hs.8719 |
| 219144_at | 126 | NM_024025/1042 | | | CD59, CD59, CD59, CD59, | Hs.278573, Hs.278573, Hs.278573, Hs.278573, |
| 212463_at | 127 | NM_000611/831 | NM_203331/1175 | NM_203330/1212 | NM_203329/1230 | |
| 202040_s_at | 128 | NM_005056/902 | | | JARID1A | Hs.76272 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 64432_at | 129 | NM_016534/ 991 | | | FLJ39616 | Hs.333120 |
| 200965_s_at | 130 | NM_006720/ 930 | NM_002313/ 1120 | NM_001003407/ 1187 | NM_001003408/ 1232 | ABLIM1, ABLIM1, ABLIM1, ABLIM1, PBP | Hs.438236, Hs.438236, Hs.438236, Hs.438236, Hs.433863 |
| 205353_s_at | 131 | NM_002567/ 866 | | | | PBP | |
| 213177_at | 132 | NM_033392/ 1057 | NM_015133/ 1138 | | MAPK8IP3, MAPK8IP3, FTS | Hs.207763, Hs.207763, Hs.380897 |
| 218373_at | 133 | NM_022476/ 1040 | | | | |
| 208333_at | 134 | NM_022363/ 1039 | | | LHX5 | Hs.302029 |
| 206150_at | 135 | NM_001242/ 851 | | | TNFRSF7 | Hs.355307 |
| 202431_s_at | 136 | NM_002467/ 863 | | | MYC | Hs.202453 |
| 207838_x_at | 137 | NM_020524/ 1023 | | | PBXIP1 | Hs.505806 |
| 218325_s_at | 138 | NM_080797/ 1062 | NM_080796/ 1149 | | DATF1, DATF1, DATF1 | Hs.551527, Hs.551527, Hs.551527 |
| 218475_at | 139 | NM_182984/ 1090 | NM_022727/ 1144 | | HTF9C, HTF9C, PUS1 | Hs.549133, Hs.549133, Hs.507295 |
| 218670_at | 140 | NM_025215/ 1053 | | | | |
| 205594_at | 141 | NM_014897/ 967 | | | ZNF652 | Hs.463375 |
| 215411_s_at | 142 | NM_147200/ 1076 | NM_147686/ 1160 | | C6ORF4, C6ORF4, KIAA0372 | Hs.486228, Hs.486228, Hs.482868 |
| 203048_s_at | 143 | NM_014639/ 962 | | | | |
| 216885_s_at | 144 | NM_015726/ 982 | | | WDR42A | Hs.492236 |
| 219767_s_at | 145 | NM_005111/ 903 | NM_145311/ 1157 | NM_145858/ 1202 | CRYZL1, CRYZL1, CRYZL1 | Hs.352671, Hs.352671, Hs.352671 |
| 219131_at | 146 | NM_013319/ 953 | | | TERE1 | Hs.522933 |
| 213176_at | 147 | NM_003573/ 877 | | | LTBP4 | Hs.466766 |
| 208661_s_at | 148 | NM_001001894/ 844 | NM_003316/ 1180 | | TTC3, TTC3 | Hs.368214, Hs.368214 |
| 208196_x_at | 149 | NM_172388/ 1083 | NM_172389/ 1164 | NM_172387/ 1206 | NM_006162/ 1220 | NFATC1, NFATC1, NFATC1, NFATC1 | Hs.534074, Hs.534074, Hs.534074, Hs.534074 |
| 212178_s_at | 150 | NM_172020/ 1081 | | | POM121 | Hs.488624 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 221601_s_at | 151 | NM_005449/ 909 | | | TOSO | Hs.58831 |
| 222013_x_at | 152 | NM_152563/ 1077 | NM_032916/ 1145 | | FLJ10661, MGC16279, FLJ10661, SPOCK2 | Hs.61142, Hs.458413, Hs.61142, Hs.523009 |
| 202524_s_at | 153 | NM_014767/ 963 | NM_018172/ 1196 | | — | — |
| 212068_s_at | 154 | — | | | — | — |
| 202830_s_at | 155 | NM_001467/ 853 | | | SLC37A4 | Hs.132760 |
| 209835_x_at | 156 | NM_001001391/ 841 | NM_001001390/ 1177 | NM_001001389/ 1186 | CD44, CD44, CD44, CD44, CD44 | Hs.502328, Hs.502328, Hs.502328, Hs.502328, Hs.502328 |
| 212257_s_at | 157 | NM_139045/ 1071 | NM_003070/ 1124 | NM_000610/ 1231 | SMARCA2, SMARCA2 | Hs.298990, Hs.298990 |
| 212071_s_at | 158 | — | | | — | — |
| 213322_at | 159 | | | | C6ORF130 | Hs.549281 |
| 210645_s_at | 160 | NM_001001894/ 844 | NM_003316/ 1180 | | TTC3, TTC3 | Hs.368214, Hs.368214 |
| 202514_at | 161 | — | | | — | — |
| 217122_s_at | 162 | NM_014854/ 964 | | | SLC35E2 | Hs.551612 |
| 218440_at | 163 | NM_020166/ 1020 | | | MCCC1 | Hs.47649 |
| 210707_x_at | 164 | NM_174930/ 1086 | NM_002679/ 867 | NM_001003686/ 1115 | NM_001003687/ 1183 | NM_000535/ 828 | PMS2L5, POM121, PMS2L3, PMS2L3, PMS2L3, PMS2, RCN3 | Hs.397073, Hs.488624, Hs.549057, Hs.549057, Hs.549057, Hs.487470, Hs.439184 |
| 61734_at | 165 | NM_020650/ 1024 | | | | | |
| 221500_s_at | 166 | NM_001001434/ 842 | NM_003763/ 880 | NM_001001433/ 1181 | STX16, STX16, STX16 | Hs.307913, Hs.307913, Hs.307913 |
| 219422_at | 167 | — | | | — | — |
| 222244_s_at | 168 | NM_017903/ 996 | | | FLJ20618 | Hs.551545 |
| 212550_at | 169 | NM_012448/ 950 | | | STAT5B | Hs.132864 |
| 206544_x_at | 170 | NM_139045/ 1071 | NM_003070/ 1124 | | SMARCA2, SMARCA2 | Hs.298990, Hs.298990 |
| 216380_x_at | 171 | NM_001031/ 847 | | | RPS28 | Hs.546293 |
| 203408_s_at | 172 | NM_002971/ 870 | | | SATB1 | Hs.517717 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 218258_at | 173 | NM_015972/ 984 | | | MGC9850 | Hs.507584 |
| 212234_at | 174 | NM_015338/ 976 | | | ASXL1 | Hs.374043 |
| 217461_x_at | 175 | NM_001207/ 849 | | | BTF3 | Hs.529798 |
| 218428_s_at | 176 | NM_016316/ 989 | | | REV1L | Hs.443077 |
| 215667_x_at | 177 | NM_002679/ 867 | NM_174930/ 1086 | NM_005395/ 908 | NM_001003686/ 1115 | NM_001003687/ 1183 | POM121, PMS2L5, PMS2L3, PMS2L3, PMS2L3, | Hs.488624, Hs.397073, Hs.549057, Hs.549057, Hs.549057, |
| 220465_at | 178 | —/ | | | | |
| 217988_at | 179 | NM_021178/ 1027 | | | CCNB1IP1, CCNB1IP1, CCNB1IP1, CCNB1IP1, FLJ12270 | Hs.107003, Hs.107003, Hs.107003, Hs.107003, Hs.280951 |
| 221981_s_at | 180 | NM_030581/ 1054 | | | | |
| 212201_at | 181 | —/ | | | | |
| 208795_s_at | 182 | NM_005916/ 916 | NM_182776/ 1168 | NM_182852/ 1169 | | MCM7, MCM7, GPSN2, GPSN2, | Hs.438720, Hs.438720, Hs.515642, Hs.515642, |
| 208336_s_at | 183 | NM_004868/ 898 | NM_138501/ 1153 | | | STX16, STX16, STX16, MMS19L | Hs.307913, Hs.307913, Hs.307913, Hs.500721 |
| 221499_s_at | 184 | NM_001001434/ 842 | NM_003763/ 880 | NM_001001433/ 1181 | | | |
| 202167_s_at | 185 | NM_022362/ 1038 | | | | |
| 201065_s_at | 186 | NR_002206/ 1107 | NM_001518/ 854 | NM_033001/ 1146 | NM_033000/ 1198 | NM_032999/ 1222 | GTF2I, GTF2I, GTF2I, GTF2I, | Hs.520459, Hs.520459, Hs.520459, Hs.520459, |
| 211172_x_at | 187 | NM_004842/ 896 | NM_138633/ 1154 | NM_016377/ 1194 | | | AKAP7, AKAP7, AKAP7, ZNF444 | Hs.486483, Hs.486483, Hs.486483, Hs.24545 |
| 218707_at | 188 | NM_018337/ 1007 | | | | |
| 206770_s_at | 189 | NM_012243/ 945 | | | SLC35A3 | Hs.448979 |
| 200898_s_at | 190 | NM_012215/ 943 | | | MGEA5 | Hs.500842 |
| 215519_x_at | 191 | NM_015705/ 981 | | | RUTBC3 | Hs.474914 |
| 212406_s_at | 192 | NM_018257/ 1005 | | | C20ORF36 | Hs.473317 |

TABLE 2-continued

| PROBESET | SEQ ID NO: | Refseq Ids/SEQ ID NO: | | | | | | | | REFSEQ_UNIGENE | REFSEQ_BAND |
|---|---|---|---|---|---|---|---|---|---|---|---|
| 210826_x_at | 193 | NM_133341/ 1066 | NM_133339/ 1151 | NM_133340/ 1200 | NM_133344/ 1224 | NM_133343/ 1239 | NM_133342/ 1237 | NM_133338/ 1243 | NM_002873/ 1246 | RAD17, RAD17, RAD17, RAD17, RAD17, RAD17, RAD17, ALG12 | Hs.16184, Hs.16184, Hs.16184, Hs.16184, Hs.16184, Hs.16184, Hs.16184, Hs.526711 |
| 218444_at | 194 | NM_024105/ 1043 | | | | | | | | LOC112869 | Hs.460487 |
| 221822_at | 195 | NM_138414/ 1070 | | | | | | | | C6ORF48 | Hs.109798 |
| 220755_s_at | 196 | NM_016947/ 992 | | | | | | | | CUTC | Hs.16606 |
| 218970_s_at | 197 | NM_015960/ 983 | | | | | | | | LGTN | Hs.497581 |
| 218253_s_at | 198 | NM_006893/ 933 | | | | | | | | DEF6 | Hs.15476 |
| 221293_s_at | 199 | NM_022047/ 1032 | | | | | | | | WAC, WAC, WAC, | Hs.435610, Hs.435610, Hs.435610, |
| 217742_s_at | 200 | NM_100486/ 1063 | NM_016628/ 1140 | NM_100264/ 1199 | | | | | | HNRPH3, HNRPH3, | Hs.499891, Hs.499891, |
| 207127_s_at | 201 | NM_021644/ 1030 | NM_012207/ 1136 | | | | | | | GNL3, GNL3, GNL3, | Hs.313544, Hs.313544, Hs.313544, |
| 217850_at | 202 | NM_206826/ 1104 | NM_014366/ 1137 | NM_206825/ 1213 | | | | | | KIAA0892 | Hs.112751 |
| 212505_s_at | 203 | NM_015329/ 974 | | | | | | | | LRPPRC | Hs.368084 |
| 211971_s_at | 204 | NM_133259/ 1065 | | | | | | | | | |
| 216387_x_at | 205 | NM_013269/ 952 | NM_001004420/ 1117 | NM_001004419/ 1185 | NM_002520/ 1218 | | | | | OCIL, OCIL, OCIL, NPM1, HMG20A | Hs.268326, Hs.268326, Hs.268326, Hs.519452, Hs.69594 |
| 218152_at | 206 | NM_018200/ 1002 | | | | | | | | | |
| 201788_at | 207 | NM_203499/ 1102 | NM_007372/ 1135 | | | | | | | DDX42, DDX42, TINP1 | Hs.8765, Hs.8765, Hs.482526 |
| 201922_at | 208 | NM_014886/ 966 | | | | | | | | | |
| 212982_at | 209 | NM_015336/ 975 | | | | | | | | ZDHHC17 | Hs.4014 |
| 214173_x_at | 210 | NM_134447/ 1068 | | | | | | | | C19ORF2, C19ORF2, | Hs.466391, Hs.466391, |
| 211937_at | 211 | NM_001417/ 852 | NM_003796/ 1128 | | | | | | | EIF4B | Hs.512629 |

TABLE 2-continued

| PROBESET | SEQ ID NO: | Refseq Ids/SEQ ID NO: | | | | | | | REFSEQ_UNIGENE | REFSEQ_BAND |
|---|---|---|---|---|---|---|---|---|---|---|
| 216843_x_at | 212 | NM_000535/ 828 | NM_174930/ 1086 | NM_002679/ 867 | NM_005395/ 908 | NM_001003686/ 1115 | NM_001003687/ 1183 | NM_032958/ 1242 | NM_032959/ 1247 | PMS2, PMS2, L5, POM121, PMS2L3, PMS2L3, PMS2L3, POLR2I2, POLR2I2, | Hs.487470, Hs.397073, Hs.488624, Hs.549057, Hs.549057, Hs.549057, Hs.433879, Hs.433879, |
| 212854_x_at | 213 | NM_032264/ 1056 | NM_173638/ 1166 | NM_183372/ 1209 | | | | | | AE2, MGC8902, LOC200030, DKFZP434C171 | Hs.325422, Hs.512037, Hs.515837, Hs.132994 |
| 212886_at | 214 | NM_015621/ 978 | | | | | | | | | |
| 220607_x_at | 215 | NM_016397/ 990 | NM_198976/ 1172 | | | | | | | TH1L, TH1L, C19ORF13 | Hs.517148, Hs.517148, Hs.407368 |
| 212132_at | 216 | NM_015578/ 977 | | | | | | | | | |
| 214042_s_at | 217 | NM_000983/ 839 | | | | | | | | RPL22 | Hs.515329 |
| 212660_at | 218 | NM_015288/ 972 | | | | | | | | PHF15 | Hs.483419 |
| 208944_at 210011_s_at | 219 220 | — NM_013986/ 956 | NM_005243/ 1130 | | | | | | | — EWSR1, EWSR1, EIF4B | — Hs.374477, Hs.374477, Hs.512629 |
| 211938_at | 221 | NM_001417/ 852 | | | | | | | | | |
| 220408_x_at | 222 | NM_017569/ 994 | | | | | | | | FAM48A | Hs.435815 |
| 212114_at 212455_at | 223 224 | — NM_133370/ 1067 | | | | | | | | — YT521 | — Hs.175955 |
| 212299_at 200005_at | 225 226 | — NM_003753/ 879 | | | | | | | | — EIF3S7 | — Hs.55682 |
| 200081_s_at | 227 | NM_001010/ 846 | | | | | | | | RPS6 | Hs.408073 |
| 213687_s_at | 228 | NM_000996/ 840 | | | | | | | | RPL35A | Hs.529631 |
| 204102_s_at | 229 | NM_001961/ 859 | | | | | | | | EEF2 | Hs.515070 |
| 211666_x_at | 230 | NM_000967/ 836 | | | | | | | | RPL3 | Hs.119598 |
| 209134_s_at | 231 | NM_001010/ 846 | | | | | | | | RPS6 | Hs.408073 |
| 221700_s_at | 232 | NM_003333/ 876 | | | | | | | | UBA52 | Hs.5308 |
| 200034_s_at | 233 | NM_000970/ 837 | | | | | | | | RPL6 | Hs.528668 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 201254_x_at | 234 | NM_001010/ 846 | | | RPS6 | Hs.408073 |
| 212734_x_at | 235 | NM_000977/ 838 | NM_033251/ 1147 | | RPL13, RPL13, | Hs.410817, Hs.410817, |
| 217718_s_at | 236 | NM_139323/ 1073 | NM_003404/ 1126 | | YWHAB, YWHAB, | Hs.279920, Hs.279920, |
| 208678_at | 237 | NM_001696/ 855 | | | ATP6V1E1 | Hs.517338 |
| 200633_at | 238 | NM_018955/ 1014 | | | UBB | Hs.356190 |
| 201318_s_at | 239 | NM_033546/ 1058 | NM_006471/ 1134 | | MRLC2, MRCL3, | Hs.464472, Hs.190086, |
| 202090_s_at | 240 | NM_006830/ 931 | | | UQCR | Hs.8372 |
| 221474_at | 241 | NM_033546/ 1058 | | | MRLC2 | Hs.464472 |
| 214629_x_at | 242 | NM_153828/ 1080 | NM_207520/ 1176 | NM_207521/ 1214 | RTN4, RTN4, RTN4, RTN4, | Hs.429581, Hs.429581, Hs.429581, Hs.429581, |
| 200067_x_at | 243 | NM_152827/ 1078 | NM_003795/ 1127 | NM_152828/ 1203 | SNX3, SNX3, SNX3, | Hs.12102, Hs.12102, Hs.12102, |
| 201899_s_at | 244 | NM_181762/ 1089 | NM_003336/ 1125 | NM_181777/ 1207 | UBE2A, UBE2A, UBE2A, | Hs.379466, Hs.379466, Hs.379466, |
| 210968_s_at | 245 | NM_153828/ 1080 | NM_207520/ 1176 | NM_207521/ 1214 NM_020532/ 1221 NM_007008/ 1236 | RTN4, RTN4, RTN4, RTN4, RTN4, | Hs.429581, Hs.429581, Hs.429581, Hs.429581, Hs.429581, |
| 200609_s_at | 246 | NM_005112/ 904 | NM_017491/ 1142 | | WDR1, WDR1, | Hs.128548, Hs.128548, |
| 208805_at | 247 | NM_002791/ 868 | | | PSMA6 | Hs.446260 |
| 218571_s_at | 248 | NM_014169/ 957 | | | C14ORF123 | Hs.279761 |
| 217730_at | 249 | NM_022152/ 1035 | | | PP1201 | Hs.98475 |
| 218520_at | 250 | NM_013254/ 951 | | | TBK1 | Hs.505874 |
| 208908_s_at | 251 | NM_173061/ 1085 | NM_173062/ 1165 | NM_173060/ 1084 NM_001750/ 1217 | CAST, CAST, CAST, CAST, | Hs.440961, Hs.440961, Hs.440961, Hs.440961, |
| 207467_x_at | 252 | NM_173061/ 1085 | NM_173062/ 1165 | NM_173060/ 1084 NM_001750/ 1217 | CAST, CAST, CAST, CAST, | Hs.440961, Hs.440961, Hs.440961, Hs.440961, |

TABLE 2-continued

| PROBESET | SEQ ID NO: | Refseq Ids/SEQ ID NO: | REFSEQ_UNIGENE | REFSEQ_BAND |
|---|---|---|---|---|
| 201975_at | 253 | NM_198240/1093 | RSN, RSN, | Hs.524809, Hs.524809, |
| 200814_at | 254 | NM_006263/920 | PSME1, PSME1, | Hs.75348, Hs.75348, |
| 203090_at | 255 | NM_006923/934 | SDF2 | Hs.514036 |
| 201470_at | 256 | NM_004832/895 | GSTO1 | Hs.190028 |
| 212586_at | 257 | NM_173060/1084 | CAST | Hs.440961 |
| 200703_at | 258 | NM_003746/878 | DNCL1 | Hs.5120 |
| 217995_at | 259 | NM_021199/1029 | SQRDL | Hs.511251 |
| 201346_at | 260 | NM_024551/1048 | ADIPOR2 | Hs.371642 |
| 201609_x_at | 261 | NM_012405/949 | ICMT, ICMT, | Hs.515688, Hs.515688, |
| 202000_at | 262 | NM_002490/864 | NDUFA6 | Hs.274416 |
| 202001_s_at | 263 | NM_002490/864 | NDUFA6 | Hs.274416 |
| 203880_at | 264 | NM_005694/914 | COX17 | Hs.534383 |
| 218525_s_at | 265 | NM_017902/995 | HIF1AN | Hs.500788 |
| 219798_s_at | 266 | NM_019606/1017 | FLJ20257 | Hs.178011 |
| 208398_s_at | 267 | NM_004865/897 | TBPL1 | Hs.486507 |
| 218358_at | 268 | NM_024324/1045 | MGC11256 | Hs.211282 |
| 203097_s_at | 269 | —/— | — | — |
| 221598_s_at | 270 | NM_004269/887 | CRS98 | Hs.374262 |
| 209546_s_at | 271 | AF323540/811 | GenBank | Hs.114309 |
| 50400_at | 272 | AI743990/812 | GenBank | Hs.24859 |
| 217752_s_at | 273 | NM_018235/1003 | GenBank | Hs.273230 |
| 201931_at | 274 | NM_000126/825 | GenBank | Hs.169919 |
| 218567_x_at | 275 | NM_005700/915 | GenBank | Hs.22880 |
| 202056_at | 276 | AW051311/816 | GenBank | Hs.169149 |
| 218907_s_at | 277 | NM_023942/1041 | GenBank | Hs.284135 |

TABLE 2-continued

| PROBESET | SEQ ID NO: | Refseq Ids/SEQ ID NO: | REFSEQ_UNIGENE | REFSEQ_BAND |
|---|---|---|---|---|
| 213726_x_at | 278 | AA515698/806 | GenBank | Hs.251653 |
| 204448_s_at | 279 | AF031463/808 | GenBank | Hs.9302 |
| 1405_i_at | 280 | M21121/823 | GenBank | — |
| 212864_at | 281 | Y16521/1108 | GenBank | Hs.24812 |
| 209444_at | 282 | BC001851/819 | GenBank | Hs.7940 |
| 208898_at | 283 | AF077614/809 | GenBank | Hs.272630 |
| 202377_at | 284 | AW026535/815 | GenBank | Hs.23581 |
| 209547_s_at | 285 | BC001043/818 | GenBank | Hs.15075 |
| 202922_at | 286 | BF676980/821 | GenBank | Hs.151393 |
| 201403_s_at | 287 | NM_004528/892 | GenBank | Hs.111811 |
| 213154_s_at | 288 | AI934125/814 | GenBank | Hs.17411 |
| 215676_at | 289 | N91109/824 | GenBank | Hs.32935 |
| 218927_s_at | 290 | NM_018641/1012 | GenBank | Hs.25204 |
| 213648_at | 291 | AW614427/817 | GenBank | Hs.182877 |
| 209593_s_at | 292 | AF317129/810 | GenBank | Hs.252682 |
| 203731_s_at | 293 | NM_014569/960 | GenBank | Hs.110839 |
| 201234_at | 294 | NM_004517/891 | GenBank | Hs.6196 |
| 214817_at | 295 | BE783668/820 | GenBank | Hs.175780 |
| 201761_at | 296 | NM_006636/929 | GenBank | Hs.154672 |
| 205467_at | 297 | NM_001230/850 | GenBank | Hs.5353 |
| 222318_at | 298 | AI744673/813 | GenBank | Hs.186970 |
| 209933_s_at | 299 | AF020314/807 | GenBank | Hs.9688 |
| 200734_s_at | 300 | BG341906/822 | GenBank | Hs.119177 |
| 219899_x_at | 301 | NM_014434/959 | NDOR1 | Hs.512564 |

TABLE 2-continued

| PROBESET | SEQ ID NO: | Refseq Ids/SEQ ID NO: | | | REFSEQ_UNIGENE | REFSEQ_BAND |
|---|---|---|---|---|---|---|
| 221563_at | 302 | NM_144729/ 1074 | NM_144728/ 1155 | NM_007207/ 1192 | DUSP10, DUSP10, DUSP10, | Hs.497822, Hs.497822, Hs.497822, |
| 65517_at | 303 | NM_005498/ 910 | | | AP1M2 | Hs.18894 |
| 205126_at | 304 | NM_006296/ 921 | | | VRK2 | Hs.468623 |
| 200696_s_at | 305 | NM_198252/ 1094 | NM_000177/ 1110 | | GSN, GSN, | Hs.522373, Hs.522373, |
| 208790_s_at | 306 | NM_012232/ 944 | | | PTRF | Hs.437191 |
| 205115_s_at | 307 | NM_016196/ 987 | | | RBM19 | Hs.7482 |
| 213982_s_at | 308 | NM_014857/ 965 | | | RABGAP1L | Hs.495391 |
| 206992_s_at | 309 | NM_015684/ 980 | NM_001003805/ 1116 | NM_001003803/ 1184 | ATP5S, ATP5S, ATP5S, | Hs.438489, Hs.438489, Hs.438489, |
| 201060_x_at | 310 | NM_198194/ 1092 | NM_004099/ 1129 | NM_017723/ 1195 | STOM, STOM, FLJ20245, | Hs.253903, Hs.253903, Hs.495541, |
| 209278_s_at | 311 | NM_006528/ 924 | | | TFPI2 | Hs.438231 |
| 210542_s_at 202006_at | 312 313 | —/ NM_002835/ 869 | | | — PTPN12 | — Hs.61812 |
| 210557_x_at | 314 | NM_172211/ 1082 | NM_000757/ 1112 | NM_172210/ 1205 | CSF1, CSF1, CSF1, CSF1, | Hs.173894, Hs.173894, Hs.173894, Hs.173894, |
| 210796_x_at | 315 | NM_198846/ 1097 | NM_198845/ 1171 | NM_001245/ 1188 | SIGLEC6, SIGLEC6, SIGLEC6, | Hs.397255, Hs.397255, Hs.397255, |
| 220825_s_at | 316 | NM_018240/ 1004 | | | KIRREL | Hs.272234 |
| 202378_s_at | 317 | NM_017526/ 993 | | | LEPR | Hs.23581 |
| 210241_s_at | 318 | NM_007233/ 936 | | | TP53AP1 | Hs.274329 |
| 213069_at 216034_at | 319 320 | —/ NM_080740/ 1061 | | | — SUHW1 | — Hs.178665 |

TABLE 2-continued

| PROBESET | SEQ ID NO: | Refseq Ids/SEQ ID NO: | | | | REFSEQ_UNIGENE | REFSEQ_BAND |
|---|---|---|---|---|---|---|---|
| 210793_s_at | 321 | NM_139131/ 1072 | NM_005387/ 1131 | | | NUP98, NUP98, | Hs.524750, Hs.524750 |
| 207375_s_at | 322 | NM_002189/ 860 | NM_172200/ 1163 | | | IL15RA, IL15RA, | Hs.524117, Hs.524117, |
| 206247_at | 323 | NM_005931/ 917 | | | | MICB | Hs.211580 |
| 217078_s_at | 324 | NM_007261/ 937 | | | | CMRF-35H | Hs.9688 |
| 219257_s_at | 325 | NM_021972/ 1031 | NM_182965/ 1170 | | | SPHK1, SPHK1, | Hs.68061, Hs.68061, |
| 204781_s_at | 326 | NM_152876/ 1079 | NM_152877/ 1161 | NM_152874/ 1204 | NM_152875/ 1225 | NM_152873/ 1238 | NM_152871/ 1240 | NM_152872/ 1244 | NM_000043/ 1245 | FAS, FAS, FAS, FAS, FAS, FAS, FAS, | Hs.244139, Hs.244139, Hs.244139, Hs.244139, Hs.244139, Hs.244139, Hs.244139, |
| 221536_s_at | 327 | NM_018385/ 1009 | | | | FLJ11301 | Hs.518505 |
| 209468_at | 328 | NM_002335/ 861 | | | | LRP5 | Hs.6347 |
| 201061_s_at | 329 | NM_198194/ 1092 | NM_004099 1129 | | | STOM, STOM, | Hs.253903, Hs.253903, |
| 203499_at | 330 | NM_004431/ 889 | | | | EPHA2 | Hs.171596 |
| 213324_at | 331 | NM_198291/ 1095 | NM_005417/ 1132 | | | SRC, SRC, | Hs.195659, Hs.195659, |
| 221535_at | 332 | NM_018385/ 1009 | | | | FLJ11301 | Hs.518505 |
| 219938_s_at | 333 | NM_024430/ 1046 | | | | PSTPIP2 | Hs.368623 |
| 213787_s_at | 334 | NM_006579/ 926 | | | | EBP | Hs.522636 |
| 219592_at | 335 | NM_024596/ 1049 | | | | MCPH1 | Hs.550532 |
| 200637_s_at | 336 | NM_130440/ 1064 | NM_002840/ 1122 | | | PTPRF, PTPRF, | Hs.272062, Hs.272062, |
| 202193_at | 337 | NM_005569/ 913 | NM_016733/ 1141 | | | LIMK2, LIMK2, | Hs.474596, Hs.474596, |
| 214859_at | 338 | NM_015082/ 969 | | | | FSTL4 | Hs.483390 |
| 209213_at | 339 | NM_001757/ 857 | | | | CBR1 | Hs.88778 |

TABLE 2-continued

| PROBESET | SEQ ID NO: | Refseq Ids/SEQ ID NO: | | | | REFSEQ_UNIGENE | REFSEQ_BAND |
|---|---|---|---|---|---|---|---|
| 218945_at | 340 | NM_024109/ 1044 | | | | MGC2654 | Hs.306380 |
| 220471_s_at | 341 | NM_025107/ 1052 | | | | MYCT1 | Hs.18160 |
| 59625_at | 342 | NM_003946/ 883 | | | | NOL3 | Hs.513667 |
| 207233_s_at | 343 | NM_198158/ 1091 | NM_198178/ 1210 | NM_198177/ 1228 | NM_006722/ 1235 | NM_198159/ 1241 | MITF, MITF, MITF, MITF, MITF, MITF, | Hs.166017, Hs.166017, Hs.166017, Hs.166017, Hs.166017, Hs.166017, |
| 214070_s_at | 344 | —/— | | | | — | — |
| 219785_s_at | 345 | —/— | | | | — | — |
| 220684_at | 346 | NM_013351/ 954 | | | | TBX21 | Hs.272409 |
| 202245_at | 347 | NM_002340/ 862 | | | | LSS | Hs.517366 |
| 207298_at | 348 | NM_006632/ 927 | | | | SLC17A3 | Hs.327179 |
| 220201_at | 349 | NM_018835/ 1013 | | | | MNAB | Hs.533499 |
| 203208_s_at | 350 | NM_014637/ 961 | | | | CHPPR | Hs.521608 |
| 207033_at | 351 | NM_051142/ 906 | | | | GIF | Hs.110014 |
| 204929_s_at | 352 | NM_006634/ 928 | | | | VAMP5 | Hs.172684 |
| 209735_at | 353 | NM_004827/ 894 | | | | ABCG2 | Hs.480218 |
| 209234_at | 354 | NM_015074/ 968 | | | | KIF1B | Hs.97858 |
| 210102_at | 355 | NM_198315/ 1096 | | | | LOH11CR2A | Hs.152944 |
| 204114_at | 356 | NM_007361/ 941 | | | | NID2 | Hs.369840 |
| 203344_s_at | 357 | NM_203292/ 1100 | NM_203291/ 1174 | NM_002894/ 1190 | | | RBBP8, RBBP8, RBBP8, | Hs.546282, Hs.546282, Hs.546282, |
| 216891_at | 358 | —/— | | | | — | — |
| 221680_s_at | 359 | NM_016135/ 986 | NM_145918/ 1159 | | | | ETV7 | Hs.272398 |
| 202087_s_at | 360 | NM_001912/ 858 | NM_005417/ 1132 | | | | CTSL, CTSL, | Hs.418123, Hs.418123, |
| 213324_at | 331 | NM_198291/ 1095 | | | | | SRC, SRC, | Hs.195659, Hs.195659, |
| 221535_at | 332 | NM_018385/ 1009 | | | | | FLJ11301 | Hs.518505 |

TABLE 2-continued

| PROBESET | SEQ ID NO: | Refseq Ids/SEQ ID NO: | | | | REFSEQ_UNIGENE | REFSEQ_BAND |
|---|---|---|---|---|---|---|---|
| 219938_s_at | 333 | NM_024430/ 1046 | | | | PSTPIP2 | Hs.368623 |
| 213787_s_at | 334 | NM_006579/ 926 | | | | EBP | Hs.522636 |
| 219592_at | 335 | NM_024596/ 1049 | | | | MCPH1 | Hs.550532 |
| 200637_s_at | 336 | NM_130440/ 1064 | NM_002840/ 1122 | | | PTPRF, PTPRF, | Hs.272062, Hs.272062, |
| 202193_at | 337 | NM_005569/ 913 | NM_016733/ 1141 | | | LIMK 2, LIMK 2, | Hs.474596, Hs.474596, |
| 214859_at | 338 | NM_015082/ 969 | | | | FSTL4 | Hs.483390 |
| 209213_at | 339 | NM_001757/ 857 | | | | CBR1 | Hs.88778 |
| 218945_at | 340 | NM_024109/ 1044 | | | | MGC2654 | Hs.306380 |
| 220471_s_at | 341 | NM_025107/ 1052 | | | | MYCT1 | Hs.18160 |
| 59625_at | 342 | NM_003946/ 883 | | | | NOL3 | Hs.513667 |
| 207233_s_at | 343 | NM_198158/ 1091 | NM_198178/ 1210 | NM_198177/ 1228 | NM_006722/ 1235 | MITF, MITF, MITF, MITF, MITF, | Hs.166017, Hs.166017, Hs.166017, Hs.166017, Hs.166017, |
| 214070_s_at | 344 | —/ | | | NM_198159/ 1241 | — | — |
| 219785_s_at | 345 | —/ | | | | — | — |
| 220684_at | 346 | NM_013351/ 954 | | | | TBX21 | Hs.272409 |
| 202245_at | 347 | NM_002340/ 862 | | | | LSS | Hs.517366 |
| 207298_at | 348 | NM_006632/ 927 | | | | SLC17A3 | Hs.327179 |
| 220201_at | 349 | NM_018835/ 1013 | | | | MNAB | Hs.533499 |
| 203208_s_at | 350 | NM_014637/ 961 | | | | CHPPR | Hs.521608 |
| 207033_at | 351 | NM_005142/ 906 | | | | GIF | Hs.110014 |
| 204929_s_at | 352 | NM_006634/ 928 | | | | VAMP5 | Hs.172684 |
| 209735_at | 353 | NM_004827/ 894 | | | | ABCG2 | Hs.480218 |
| 209234_at | 354 | NM_015074/ 968 | | | | KIF1B | Hs.97858 |
| 210102_at | 355 | NM_198315/ 1096 | | | | LOH11CR2A | Hs.152944 |

TABLE 2-continued

| PROBESET | SEQ ID NO: | Refseq Ids/SEQ ID NO: | | REFSEQ_UNIGENE | REFSEQ_BAND |
|---|---|---|---|---|---|
| 204114_at | 356 | NM_007361/ 941 | | NID2 | Hs.369840 |
| 203344_s_at | 357 | NM_203292/ 1100 | NM_203291/ 1174 | RBBP8, RBBP8, RBBP8, | Hs.546282, Hs.546282, Hs.546282, |
| 216891_at | 358 | —/— | | — | — |
| 221680_s_at | 359 | NM_016135/ 986 | | ETV7 | Hs.272398 |
| 202087_s_at | 360 | NM_001912/ 858 | NM_145918/ 1159 | CTSL, CTSL, SIAT8A | Hs.418123, Hs.418123, Hs.408614 |
| 210073_at | 391 | NM_003034/ 871 | | | |
| 209524_at | 392 | NM_016073/ 985 | | HDGFRP3 | Hs.513954 |
| 219759_at | 393 | NM_022350/ 1036 | | LRAP | Hs.482910 |
| 202112_at | 394 | NM_000552/ 830 | | VWF | Hs.440848 |
| 219410_at | 395 | NM_018004/ 1000 | | FLJ10134 | Hs.126598 |
| 203819_s_at | 396 | NM_006547/ 925 | | IMP-3 | Hs.432616 |
| 212730_at | 397 | NM_015286/ 971 | NM_145728/ 1158 | DMN, DMN, | Hs.207106, Hs.207106, |
| 220122_at | 398 | —/— | | — | — |
| 208782_at | 399 | NM_007085/ 935 | | FSTL1 | Hs.269512 |
| 202468_s_at | 400 | NM_003798/ 882 | | CTNNAL1 | Hs.58488 |
| 207018_s_at | 401 | NM_004163/ 886 | | RAB27B | Hs.25318 |
| 210354_at | 402 | NM_000619/ 832 | | IFNG | Hs.856 |
| 201110_s_at | 403 | NM_003246/ 874 | | THBS1 | Hs.164226 |
| 207808_s_at | 404 | NM_000313/ 827 | | PROS1 | Hs.64016 |
| 205612_at | 405 | NM_007351/ 940 | | MMRN1 | Hs.268107 |
| 214073_at | 406 | —/— | | — | — |

The genes encoding RNA polymerase I transcription factor (RRN3) and leucine-rich PPR-motif containing protein (LRPRC) were found as most significantly down-regulated genes in BMS signature (Table 1, hereinabove). RRN33 (transcription initiation factor TIF-IA), a 72-kDa protein, is essential for ribosomal DNA (rDNA) transcription and acts as a bridge between RNA pol I and the committed rDNA promoter (Hirschler-Laszkiewicz I, et al., 2003; Miller G, et al., 2001; 20:1373-1382). The suppression of polymerase I regulation mechanism is confirmed by down-regulation of polymerase (RNA) I polypeptide D (POLR1D).

LRPPRC is a candidate gene for the French-Canadian type of Leigh syndrome, a form of cytochrome c oxidase deficiency, and plays a role in translation or stability of mitochondrially encoded cytochrome c oxidase (COX) subunits (Mootha V K, et al., 2003). The LRPPC together with POLR1D molecules comprise a complex with NFkBIB protein (Bouwmeester T, et al., 2004) that inhibits proinflammatory NFkB pathway.

Without being bound by any theory, the suppression of molecules involved in polymerase I related mechanism, COXI and NFkB regulation could account for the differences between BMS and typical RRMS patients. In addition, the polymerase I related mechanism can be potential drug targets for the treatment of RRMS aimed to switch RRMS to the BMS variant. One of commercially available drug that has proven effects on polymerase I mechanism is a diterpenoid triepoxide Triptolide (TPT), isolated from the Chinese herb *Tripterygium wilfordii* (Leuenroth S J and Crews C M. Triptolide-induced transcriptional arrest is associated with changes in nuclear substructure. Cancer Res. 2008; 68:5257-5266). Triptolide has various anti-inflammatory effects (Liu Y, et al. Triptolide, a component of Chinese herbal medicine, modulates the functional phenotype of dendritic cells. Transplantation. 2007; 84:1517-1526), it modulates T-cell inflammatory responses and ameliorates Experimental Autoimmune Encephalomyelitis (Wang Y, et al. Triptolide modulates T-cell inflammatory responses and ameliorates experimental autoimmune encephalomyelitis. J Neurosci Res. 2008; 86:2441-2449).

More specifically TPT demonstrated to suppress of T lymphocyte function including T cell apoptosis induction, inhibition of lymphocyte proliheration and IFNγ production (Chen B J. 2001. Triptolide, a novel immunosuppressive and anti-inflammatory agent purified from a Chinese herb *Tripterygium wilfordii* Hook f. Leuk Lymphoma 42:253-265; Qiu D, Kao P N. 2003 Immunosuppressive and anti-inflammatory mechanisms of triptolide, the principal active diterpenoid from the Chinese medicinal herb *Tripterygium wilfordii* Hook f. Drugs R D 4:1-18; Yang Y, Liu Z, Tolosa E, Yang J, Li L. 1998. Triptolide induces apoptotic death of T lymphocyte. Immunopharmacology 40:139-149; Chan M A, Kohlmeier J E, Branden M, Jung M, Benedict S H. 1999. Triptolide is more effective in preventing T cell proliferation and interferon-gamma production than is FK506. Phytother Res 13:464-467). The TPT decreased IL2 and IL2 receptor expression by inhibiting activation of the purine box regulator of the NFkB of activated T cells (Qiu 1999). Additionally, it was demonstrated that TPT can inhibit the maturation, antigen processing, and presentation of dendritic cells and can suppress tumor necrosis factor (TNF)-a and IL-6 production by activated macrophages (Zhu K J, Shen Q Y, Cheng H, Mao X H, Lao L M, Hao G L. 2005. Triptolide affects the differentiation, maturation and function of human dendritic cells. Int Immunopharmacol 5:1415-1426; Wu Y, Cui J, Bao X, Chan S, Young D O, Liu D, Shen P. 2006. Triptolide attenuates oxidative stress, NF-kappaB activation and multiple cytokine gene expression in murine peritoneal macrophage. Int J Mol Med 17:141-150).

Table 3, hereinbelow, discloses the genes involved in the RNA polymerase I pathway, which are likely to be involved in typical RRMS or BMS pathology.

TABLE 3

Genes involved in the RNA polymerase I pathway

| Affymetrix ProbSet | SEQ ID NO: | Representative Public ID/SEQ ID NO: | Gene Symbol | Gene Title |
|---|---|---|---|---|
| 216902_s_at | 62 | AF001549/1284; NM_018427/1285 | RRN3 | RRN3 RNA polymerase I transcription factor homolog |
| 211971_s_at | 204 | AI653608/1286; NM_133259/1287 | LRPPRC | leucine-rich PPR-motif containing |
| 220113_x_at | 1248 | NM_019014/1288 | POLR1B | polymerase (RNA) I polypeptide B, 128 kDa |
| 207515_s_at | 1249 | NM_004875/1289 | POLR1C | polymerase (RNA) I polypeptide C, 30 kDa |
| 209317_at | 1250 | AF008442/1290 | POLR1C | polymerase (RNA) I polypeptide C, 30 kDa |
| 218258_at | 173 | NM_015972/1291 | POLR1D | polymerase (RNA) I polypeptide D, 16 kDa |
| 202725_at | 1251 | NM_000937/1292 | POLR2A | polymerase (RNA) II (DNA directed) polypeptide A, 220 kDa |
| 217420_s_at | 1252 | M21610/1293 | POLR2A | polymerase (RNA) II (DNA directed) polypeptide A, 220 kDa |
| 201803_at | 1253 | NM_000938/1294 | POLR2B | polymerase (RNA) II (DNA directed) polypeptide B, 140 kDa |
| 208996_s_at | 1254 | BC000409/1295 | POLR2C | polymerase (RNA) II (DNA directed) polypeptide C, 33 kDa |
| 214263_x_at | 1255 | AI192781/1296 | POLR2C | polymerase (RNA) II (DNA directed) polypeptide C, 33 kDa |
| 216282_x_at | 1256 | AJ224143/1297 | POLR2C | polymerase (RNA) II (DNA directed) polypeptide C, 33 kDa |
| 203664_s_at | 1257 | NM_004805/1298 | POLR2D | polymerase (RNA) II (DNA directed) polypeptide D |

TABLE 3-continued

Genes involved in the RNA polymerase I pathway

| Affymetrix ProbSet | SEQ ID NO: | Representative Public ID/SEQ ID NO: | Gene Symbol | Gene Title |
|---|---|---|---|---|
| 214144_at | 1258 | BF432147/1299 | POLR2D | polymerase (RNA) II (DNA directed) polypeptide D |
| 213887_s_at | 1259 | AI554759/1300 | POLR2E | polymerase (RNA) II (DNA directed) polypeptide E, 25 kDa |
| 217854_s_at | 1260 | BC004441/1301 | POLR2E | polymerase (RNA) II (DNA directed) polypeptide E, 25 kDa |
| 209511_at | 1261 | BC003582/1302 | POLR2F | polymerase (RNA) II (DNA directed) polypeptide F |
| 202306_at | 1262 | NM_002696/1303 | POLR2G | polymerase (RNA) II (DNA directed) polypeptide G |
| 209302_at | 1263 | U37689/1304 | POLR2H | polymerase (RNA) II (DNA directed) polypeptide H |
| 212955_s_at | 1264 | AL037557/1305 | POLR2I | polymerase (RNA) II (DNA directed) polypeptide I, 14.5 kDa |
| 212782_x_at | 1265 | BG335629/1306 | POLR2J | polymerase (RNA) II (DNA directed) polypeptide J, 13.3 kDa |
| 216242_x_at | 1266 | AW402635/1307 | POLR2J2 | DNA directed RNA polymerase II polypeptide J-related gene |
| 214740_at | 1267 | BE676209/1308 | POLR2J2 /// MGC13098 | DNA directed RNA polymerase II polypeptide J-related gene /// hypothetical prote |
| 202634_at | 1268 | AL558030/1309 | POLR2K | polymerase (RNA) II (DNA directed) polypeptide K, 7.0 kDa |
| 202635_s_at | 1269 | NM_005034/1310 | POLR2K | polymerase (RNA) II (DNA directed) polypeptide K, 7.0 kDa |
| 202586_at | 1270 | AA772747/1311 | POLR2L | polymerase (RNA) II (DNA directed) polypeptide L, 7.6 kDa |
| 211730_s_at | 1271 | BC005903/1312 | POLR2L | polymerase (RNA) II (DNA directed) polypeptide L, 7.6 kDa /// polymerase (RNA) II |
| 219459_at | 1272 | NM_018082/1313 | POLR3B | polymerase (RNA) III (DNA directed) polypeptide B |
| 209382_at | 1273 | U93867/1314 | POLR3C | polymerase (RNA) III (DNA directed) polypeptide C (62 kD) |
| 210573_s_at | 1274 | BC004424/1315 | POLR3C | polymerase (RNA) III (DNA directed) polypeptide C (62 kD) |
| 208361_s_at | 1275 | NM_001722/1316 | POLR3D | polymerase (RNA) III (DNA directed) polypeptide D, 44 kDa |
| 218016_s_at | 1276 | NM_018119/1317 | POLR3E | polymerase (RNA) III (DNA directed) polypeptide E (80 kD) |
| 205218_at | 1277 | NM_006466/1318 | POLR3F | polymerase (RNA) III (DNA directed) polypeptide F, 39 kDa |
| 206653_at | 1278 | BF062139/1319 | POLR3G | Polymerase (RNA) III (DNA directed) polypeptide G (32 kD) |
| 206654_s_at | 1279 | NM_006467/1320 | POLR3G | polymerase (RNA) III (DNA directed) polypeptide G (32 kD) |
| 218866_s_at | 1280 | AF060223/1321 | POLR3K | polymerase (RNA) III (DNA directed) polypeptide K, 12.3 kDa |
| 203782_s_at | 1281 | NM_005035/1322 | POLRMT | polymerase (RNA) mitochondrial (DNA directed) |
| 203783_x_at | 1282 | BF057617/1323 | POLRMT | polymerase (RNA) mitochondrial (DNA directed) |
| 202466_at | 1283 | NM_006999/1324 | POLS | polymerase (DNA directed) sigma |

The measurement of RRN3, LRPPRC, POLR1D and other polymerase I mechanism related biomarkers could be used for diagnosis and prediction of BMS. Additionally those markers could be useful for typical RRMS patients to monitor the efficacy of various immunomodulatory drugs for assessment of patients with good response to treatment.

Measurement of BMS biomarkers can be performed on the mRNA level by the quantitative reverse-transcriptase polymerase chain reaction (QRT-PCR) method and on protein level by LUMINEX technology. Possible modification of the invention is developing biomarkers on protein level (e.g., using ELISA, Western Blot analysis and the like) in PBMC and serum.

Multiple sclerosis (MS) is a heterogeneous disease. To better diagnose and treat MS patients the various types of disease have to be distinguished. The teachings of the invention enable, for the first time, to distinguish between BMS and typical RRMS patients using molecular tools, which when combined with accurate clinical information enables to dissect the biological complexity of MS.

In the current study the use of gene expression profiling enabled to diagnose benign MS using a phenotypic approach to differentiate subtypes of the disease. The identified gene expression phenotypes also enable to better understand the biology of benign MS and to develop therapeutics strategies to treat MS.

The gene expression signature generated herein of benign MS enables refining MS to diagnose low risk patients versus high risk patients and accordingly suggest appropriate treatment.

The benign MS patients that represent low risk would not be treated while the high risk relapsing-remitting MS patients will be treated. In addition, the teachings of the invention enable to monitor response to treatment and better use of current approved medications.

The teachings of the invention can be used to develop a kit or device for diagnosis and prediction of typical RRMS clinical outcome, improving medical decision support systems and individualizing patient care. In addition, the teachings of the invention can be used to develop new drugs that will imitate BMS gene expression signature and will result in silencing of the active RRMS.

Example 2

Study Subject and Methods
Subjects—
31 patients (age 44.5±1.5; female to male ratio 24:7) with BMS were characterized by mean EDSS 1.95±0.15, disease duration 17.0±1.3 years, annual EDSS rate 0.13±0.01, annual relapse rate 0.23±0.04. 36 patients (age 40.3±1.8; female to male ratio 8:3) with RRMS were characterized by mean EDSS 3.54±0.23, disease duration 10.9±1.4 years, annual EDSS rate 0.45±0.06, annual relapse rate 0.64±0.09.

RNA Isolation and Microarray Expression Profiling—
Peripheral blood mononuclear cells (PBMC) were separated on ficoll-hypaque gradient. Total RNA was isolated using the TRIzol Reagent (Invitrogen, Carlsbad, Calif.), and cDNA was synthesized, labeled and hybridized to HG-U133A-2 array (Affymetrix, Inc, Santa Clara, Calif.) containing 22,215 gene-transcripts, washed and scanned (Hewlett Packard, GeneArray-TM scanner G2500A) according to manufacturer's protocol Affymetrix (Inc, Santa Clara, Calif.).

Data Analysis—
Data analysis was performed using the Partek Genomics Solution software [World Wide Web (dot) partek (dot) com]. Expression values were computed from raw CEL (cells) files by applying the Robust Multi-Chip Average (RMA) background correction algorithm. The RMA correction included: 1) values background correction; 2) quantile normalization; 3) log 2 transformation; 4) median polish summarization. The gene transcripts were filtered using Affymetrix MASS Present/Absent Detection. Thereafter, 9987 transcript that were detected as Present in 100% microarrays were used for analysis. In order to avoid the noise caused by variable set effects each set was normalized to pre-saved distribution pattern of a well balanced set used as a reference distribution. To reduce batch effect ANOVA multiple model analysis was applied. Source of variation was analyzed; nuisance batches effects such as working batch, patient age, gender and treatment were eliminated. Most informative genes (MIGs) were defined as genes that passed Falls Discavery Rate (FDR) correction with p<0.05 by ANOVA linear contrasts model. Thereafter, predictive algorithm based on two level cross validation method, Super Vector Machine (SVM) and K-Nearest Neighbor algorithms were applied to calculate MIGs classification rates. Only genes which were included in classifiers (from 1 to 10 genes) with more than 70% correct classification rates were analyzed.

Experimental Results

Identification of Classification Rates of Genes Involved in the RNA Polymerase I Pathway Between Typical RRMS and BMS Disease Course—
Tables 4A-C presents the corrected classification rates for all combinations of RRN3, LRPPRC and POLR1D genes of the RNA polymerase I pathway for the entire BMS and typical RRMS group (Table 4A), for the BMS group (Table 4B) and for the typical RRMS group (Table 4C). The best predictive performance for each classifier is presented.

TABLE 4A

| Classifiers | Aver. % Correct | St. Err (%) |
|---|---|---|
| RRN3 | 63.6 | 11.2 |
| LRPPRC | 73.3 | 9.5 |
| POLR1D | 72.7 | 9.5 |
| RRN3, POLR1D | 72.7 | 9.5 |
| RRN3, LRPPRC | 63.6 | 10.2 |
| POLR1D, LRPPRC | 81.8 | 8.2 |
| RRN3, LRPPRC, POLR1D | 77.2 | 8.9 |

Average % correct = Average percent of correct classification between BMS and typical RRMS patients using specific classifier;
St. Err. = standard error;

TABLE 4B

| Classifiers | BMS % corr |
|---|---|
| RRN3 | 67 |
| LRPPRC | 80 |
| POLR1D | 60 |
| RRN3, POLR1D | 60 |
| RRN3, LRPPRC | 30 |
| POLR1D, LRPPRC | 80 |
| RRN3, LRPPRC, POLR1D | 70 |

BMS % Corr. = Average percent of correct classification for BMS patients using specific classifier;

TABLE 4C

| Classifiers | Typical RRMS % corr |
|---|---|
| RRN3 | 60 |
| LRPPRC | 67 |
| POLR1D | 80 |
| RRN3, POLR1D | 83 |
| RRN3, LRPPRC | 90 |
| POLR1D, LRPPRC | 83 |
| RRN3, LRPPRC, POLR1D | 83 |

RRMS % Corr. - Average percent of correct classification for typical RRMS patients using specific classifier.

The results presented in Table 4B demonstrate that for classification of BMS, each of the genes of the RNA polymerase I pathway, i.e., RRN3, LRPPRC and POLR1D exhibits a correct classification rate of 67%, 80% and 60%, respectively. The results presented in Table 4C demonstrate that for classification of typical RRMS, each of RRN3, LRPPRC and POLR1D exhibits a correct classification rate of 60%, 67% and 80%, respectively. In addition, an increased rate of correct classification of typical RRMS, which is a more complex and heterogenous condition, can be achieved using a combination of 2 or 3 genes of the RNA polymerase I pathway. For example, a correct classification rate of 83% is obtained using the combination of RRN3 and POLR1D; a correct classification rate of 83% is obtained using the combination of POLR1D and LRPPRC; and a correct classification rate of 90% is obtained using the combination of RRN3 and LRPPRC (Table 4C, above).

The classification for the combination of RRN3 and LRPPRC resulted in outstanding classification rate of 90% of typical RRMS (TMS) (Table 4C), while showing a low 30% classification for these 2 genes for BMS (Table 4B), further supporting the differentiations between the two disease patterns.

To conclude, correct classification for both groups would be achieved using more than one combination of genes of the RNA polymerase I pathway, for example LRPPRC alone or with POLR1D reached 80% classification rate for BMS and RRN3 and LRPPRC correctly classify 90% of TMS patients.

Identification of Biomarkers for Differentiation of Patients with BMS or Typical RRMS Course of Disease—
BMS patients differentiated from typical RRMS by 177 MIGs (Table 5). The 17 genes with higher classification performance (Table 6) were identified from MIGs by applying predictive algorithms.

TABLE 5

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 216902_s_at | 62 | AF001549 | 468 | 2.12E−08 | −2.01 | RRN3 | RRN3 RNA polymerase I transcription factor homolog (yeast) |
| 210502_s_at | 1410 | AF042386 | 1534 | 2.30E−08 | −1.28 | PPIE | peptidylprolyl isomerase E (cyclophilin E) |
| 211615_s_at | 1418 | M92439 | 1512 | 2.44E−08 | −1.20 | LRPPRC | leucine-rich PPR-motif containing /// leucine-rich PPR-motif containing |
| 37950_at | 1500 | X74496 | 1526 | 1.05E−06 | 1.19 | PREP | prolyl endopeptidase |
| 218258_at | 173 | NM_015972 | 984 | 1.92E−06 | −1.18 | POLR1D | polymerase (RNA) I polypeptide D, 16 kDa |
| 214439_x_at | 1453 | AF043899 | 1535 | 2.24E−06 | −1.62 | BIN1 | bridging integrator 1 |
| 214450_at | 1454 | NM_001335 | 1629 | 3.82E−06 | −1.45 | CTSW | cathepsin W (lymphopain) /// cathepsin W (lymphopain) |
| 214470_at | 1455 | NM_002258 | 1615 | 3.83E−06 | −1.77 | KLRB1 | killer cell lectin-like receptor subfamily B, member 1 /// killer cell lectin-li |
| 205789_at | 1373 | NM_001766 | 1627 | 4.32E−06 | 1.62 | CD1D | CD1D antigen, d polypeptide /// CD1D antigen, d polypeptide |
| 206584_at | 1378 | NM_015364 | 1650 | 5.84E−06 | 1.59 | LY96 | lymphocyte antigen 96 |
| 212252_at | 1425 | AA181179 | 1660 | 6.14E−06 | 1.62 | CAMKK2 | calcium/calmodulin-dependent protein kinase kinase 2, beta |
| 212748_at | 1431 | AB037859 | 1583 | 7.92E−06 | 1.18 | MKL1 | megakaryoblastic leukemia (translocation) 1 |
| 211654_x_at | 1419 | M17565 | 1519 | 9.99E−06 | 2.75 | HLA-DQB1 | major histocompatibility complex, class II, DQ beta 1 /// major histocompatibili |
| 204860_s_at | 1370 | AI817801 | 1673 | 1.21E−05 | 1.62 | BIRC1 | baculoviral IAP repeat-containing 1 |
| 211971_s_at | 204 | AI653608 | 606 | 1.62E−05 | −1.14 | LRPPRC | leucine-rich PPR-motif containing |
| 202832_at | 1347 | NM_014635 | 1601 | 2.21E−05 | −1.33 | GCC2 | GRIP and coiled-coil domain containing 2 |
| 40446_at | 1502 | AL021366 | 1537 | 2.62E−05 | −1.39 | PHF1 | PHD finger protein 1 |
| 210136_at | 1404 | AW070431 | 1676 | 2.71E−05 | −1.76 | MBP | Myelin basic protein |
| 202441_at | 1342 | AL568449 | 1691 | 3.92E−05 | 1.37 | C10orf69 | chromosome 10 open reading frame 69 |
| 213241_at | 1442 | AF035307 | 1532 | 4.12E−05 | 1.55 | PLXNC1 | Plexin C1 |
| 212978_at | 1435 | AU146004 | 1686 | 4.13E−05 | 1.56 | TA-LRRP | T-cell activation leucine repeat-rich protein |
| 220005_at | 1490 | NM_023914 | 1591 | 4.55E−05 | 2.43 | P2RY13 | purinergic receptor P2Y, G-protein coupled, 13 /// purinergic receptor P2Y, G-pr |
| 218304_s_at | 1473 | NM_022776 | 1645 | 4.89E−05 | 1.58 | OSBPL11 | oxysterol binding protein-like 11 |
| 218932_at | 1480 | NM_017953 | 1652 | 5.00E−05 | −1.27 | FLJ20729 | hypothetical protein FLJ20729 |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 213106_at | 1440 | AI769688 | 1670 | 5.57E−05 | −1.51 | ATP8A1 | ATPase, aminophospholipid transporter (APLT), Class I, type 8A, member 1 |
| 219892_at | 1489 | NM_023003 | 1648 | 5.63E−05 | 1.86 | TM6SF1 | transmembrane 6 superfamily member 1 |
| 219666_at | 1486 | NM_022349 | 1585 | 6.07E−05 | 1.81 | MS4A6A | membrane spanning 4-domains, subfamily A, member 6A |
| 206120_at | 1376 | NM_001772 | 1631 | 6.26E−05 | 1.58 | CD33 | CD33 antigen (gp67) |
| 209970_x_at | 1403 | M87507 | 1523 | 6.51E−05 | 1.33 | CASP1 | caspase 1, apoptosis-related cysteine protease (interleukin 1, beta, convertase) |
| 200980_s_at | 1330 | NM_000284 | 1654 | 8.59E−05 | −1.27 | PDHA1 | pyruvate dehydrogenase (lipoamide) alpha 1 |
| 200610_s_at | 1326 | NM_005381 | 1613 | 8.97E−05 | −1.17 | NCL | nucleolin |
| 213418_at | 1445 | NM_002155 | 1609 | 8.99E−05 | 2.73 | HSPA6 | heat shock 70 kDa protein 6 (HSP70B') |
| 212421_at | 1429 | AB023147 | 1545 | 9.22E−05 | 1.66 | C22orf9 | chromosome 22 open reading frame 9 |
| 210201_x_at | 1407 | AF001383 | 1531 | 9.59E−05 | −1.59 | BIN1 | bridging integrator 1 |
| 207000_s_at | 1381 | NM_005605 | 1600 | 9.72E−05 | −1.32 | PPP3CC | protein phosphatase 3 (formerly 2B), catalytic subunit, gamma isoform (calcineur |
| 203139_at | 1352 | NM_004938 | 1623 | 0.000102879 | 1.78 | DAPK1 | death-associated protein kinase 1 |
| 211368_s_at | 1416 | U13700 | 1527 | 0.000107311 | 1.36 | CASP1 | caspase 1, apoptosis-related cysteine protease (interleukin 1, beta, convertase) |
| 212820_at | 1433 | AB020663 | 1582 | 0.000108529 | 1.70 | RC3 | rabconnectin-3 |
| 216945_x_at | 15 | U79240 | 421 | 0.000111457 | −1.86 | PASK | PAS domain containing serine/threonine kinase |
| 209337_at | 1395 | AF063020 | 1540 | 0.000112781 | −1.35 | PSIP1 | PC4 and SFRS1 interacting protein 1 |
| 201756_at | 1337 | NM_002946 | 1599 | 0.000114388 | −1.41 | RPA2 | replication protein A2, 32 kDa |
| 221565_s_at | 1493 | BC000039 | 1602 | 0.00011473 | 1.50 | FAM26B | family with sequence similarity 26, member B |
| 117_at | 1325 | X51757cds | #N/A | 0.000116998 | 2.01 | HSPA6 | heat shock 70 kDa protein 6 (HSP70B') |
| 43544_at | 1503 | AA314406 | 1661 | 0.000118986 | −1.65 | THRAP5 | thyroid hormone receptor associated protein 5 |
| 219132_at | 1483 | NM_021255 | 1621 | 0.000121966 | 1.36 | PELI2 | pellino homolog 2 (Drosophila) |
| 57715_at | 1507 | W72694 | 1657 | 0.000123909 | 1.35 | FAM26B | family with sequence similarity 26, member B |
| 220066_at | 1491 | NM_022162 | 1569 | 0.000125076 | 1.53 | CARD15 | caspase recruitment domain family, member 15 |
| 212414_s_at | 1428 | D50918 | 1528 | 0.000139145 | −1.53 | SEPT6 | septin 6 |
| 213902_at | 1448 | AI379338 | 1666 | 0.000139994 | 1.32 | ASAH1 | N-acylsphingosine amidohydrolase (acid ceramidase) 1 |
| 212998_x_at | 1436 | AI583173 | 1667 | 0.000143667 | 2.26 | HLA-DQB1 | major histocompatibility complex, class II, DQ beta 1 /// major histocompatibili |
| 202931_x_at | 1350 | NM_004305 | 1584 | 0.000148834 | −1.55 | BIN1 | bridging integrator 1 |
| 204112_s_at | 1361 | NM_006895 | 1619 | 0.00014954 | 1.81 | HNMT | histamine N-methyltransferase |
| 205467_at | 297 | NM_001230 | 850 | 0.000150498 | 1.44 | CASP10 | caspase 10, apoptosis related cysteine protease |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 209199_s_at | 1394 | N22468 | 1656 | 0.000157534 | 1.51 | MEF2C | MADS box transcription enhancer factor 2, polypeptide C (myocyte enhancer factor |
| 211676_s_at | 1421 | AF056979 | 1578 | 0.000157969 | 1.40 | IFNGR1 | interferon gamma receptor 1 /// interferon gamma receptor 1 |
| 203492_x_at | 1355 | AA918224 | 1664 | 0.000163582 | −1.22 | KIAA0092 | translokin |
| 211776_s_at | 1423 | BC006141 | 1577 | 0.000164075 | 3.18 | EPB41L3 | erythrocyte membrane protein band 4.1-like 3 /// erythrocyte membrane protein ba |
| 56919_at | 1505 | AI806628 | 1672 | 0.000173847 | 1.32 | KIAA1449 | WD repeat endosomal protein |
| 202521_at | 1344 | NM_006565 | 1616 | 0.0001784 | −1.14 | CTCF | CCCTC-binding factor (zinc finger protein) |
| 211727_s_at | 1422 | BC005895 | 1576 | 0.000179886 | −1.49 | COX11 | COX11 homolog, cytochrome c oxidase assembly protein (yeast) /// COX11 homolog, |
| 204222_s_at | 1363 | NM_006851 | 1628 | 0.00018487 | 1.54 | GLIPR1 | GLI pathogenesis-related 1 (glioma) |
| 204839_at | 1369 | NM_015918 | 1603 | 0.000185062 | −1.21 | POP5 | processing of precursor 5, ribonuclease P/MRP subunit (S. cerevisiae) |
| 39729_at | 1501 | L19185 | 1524 | 0.000185886 | −1.62 | PRDX2 | peroxiredoxin 2 |
| 221078_s_at | 1492 | NM_018084 | 1646 | 0.000188529 | 1.49 | KIAA1212 | KIAA1212 |
| 35156_at | 1499 | AL050297 | 1548 | 0.000196739 | −1.24 | LOC203069 | Hypothetical protein LOC203069 |
| 219630_at | 1485 | NM_005764 | 1606 | 0.000198793 | 1.94 | MAP17 | membrane-associated protein 17 |
| 202662_s_at | 1345 | NM_002223 | 1625 | 0.00020557 | 1.34 | ITPR2 | inositol 1,4,5-triphosphate receptor, type 2 |
| 210212_x_at | 1409 | BC002600 | 1571 | 0.000219441 | −1.27 | MTCP1 | mature T-cell proliferation 1 |
| 217925_s_at | 1471 | NM_022758 | 1610 | 0.000224904 | −1.21 | C6orf106 | chromosome 6 open reading frame 106 |
| 218739_at | 1477 | NM_016006 | 1643 | 0.000228499 | 1.75 | ABHD5 | abhydrolase domain containing 5 |
| 56197_at | 1504 | AI783924 | 1671 | 0.000231008 | −1.24 | PLSCR3 | phospholipid scramblase 3 |
| 208653_s_at | 1388 | AF263279 | 1561 | 0.00023174 | 1.46 | CD164 | CD164 antigen, sialomucin |
| 213292_s_at | 1444 | AA908770 | 1663 | 0.00023191 | 1.54 | SNX13 | sorting nexin 13 |
| 201194_at | 1331 | NM_003009 | 1608 | 0.000240228 | −1.36 | SEPW1 | selenoprotein W, 1 |
| 201619_at | 1336 | NM_006793 | 1596 | 0.000250445 | 1.27 | PRDX3 | peroxiredoxin 3 |
| 203569_s_at | 1356 | NM_003611 | 1640 | 0.000272476 | −1.45 | OFD1 | oral-facial-digital syndrome 1 |
| 213979_s_at | 1450 | BF984434 | 1689 | 0.00027541 | −3.22 | — | — |
| 203814_s_at | 1359 | NM_000904 | 1635 | 0.000281273 | 1.67 | NQO2 | NAD(P)H dehydrogenase, quinone 2 |
| 215118_s_at | 1462 | AW519168 | 1680 | 0.000302493 | −2.77 | MGC27165 | Hypothetical protein MGC27165 |
| 203624_at | 1357 | NM_005088 | 1607 | 0.000330513 | −1.38 | DXYS155E | DNA segment on chromosome X and Y (unique) 155 expressed sequence |
| 206999_at | 1380 | NM_001559 | 1588 | 0.000344019 | 2.07 | IL12RB2 | interleukin 12 receptor, beta 2 |
| 205842_s_at | 1374 | AF001362 | 1538 | 0.000351718 | 1.85 | JAK2 | Janus kinase 2 (a protein tyrosine kinase) |
| 210166_at | 1405 | AF051151 | 1536 | 0.000353968 | 1.63 | TLR5 | toll-like receptor 5 |
| 219714_s_at | 1487 | NM_018398 | 1612 | 0.000364622 | 2.39 | CACNA2D3 | calcium channel, voltage-dependent, alpha 2/delta 3 subunit |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 212311_at | 1426 | AA522514 | 1662 | 0.000370292 | −1.36 | KIAA0746 | KIAA0746 protein |
| 213830_at | 1447 | AW007751 | 1675 | 0.000370999 | −1.69 | TRD @ | T-cell receptor delta chain HE/801 /// T cell receptor delta locus |
| 213005_s_at | 1438 | D79994 | 1614 | 0.000376513 | 2.26 | ANKRD15 | ankyrin repeat domain 15 |
| 202944_at | 1351 | NM_000262 | 1639 | 0.000376931 | 1.68 | NAGA | N-acetylgalactosaminidase, alpha- |
| 206011_at | 1375 | AI719655 | 1668 | 0.000379898 | 1.49 | CASP1 | caspase 1, apoptosis-related cysteine protease (interleukin 1, beta, convertase) |
| 204332_s_at | 1365 | M64073 | 1516 | 0.000382893 | −1.22 | AGA | aspartylglucosaminidase |
| 215592_at | 1463 | AU147620 | 1687 | 0.000385413 | −1.91 | — | Transcribed locus, weakly similar to XP_375099.1 hypothetical protein LOC283585 |
| 201798_s_at | 378 | NM_013451 | 777 | 0.000387903 | 2.24 | FER1L3 | fer-1-like 3, myoferlin (C. elegans) |
| 212069_s_at | 1424 | AK026025 | 1566 | 0.000388281 | −1.17 | KIAA0515 | KIAA0515 |
| 206255_at | 1377 | NM_001715 | 1597 | 0.000395152 | −1.72 | BLK | B lymphoid tyrosine kinase |
| 221932_s_at | 1497 | AA133341 | 1658 | 0.000396589 | −1.42 | C14orf87 | chromosome 14 open reading frame 87 |
| 203246_s_at | 1353 | NM_006545 | 1611 | 0.000402598 | −1.33 | TUSC4 | tumor suppressor candidate 4 |
| 213534_s_at | 19 | D50925 | 425 | 0.000408073 | −1.73 | PASK | PAS domain containing serine/threonine kinase |
| 219045_at | 1481 | NM_019034 | 1604 | 0.000412198 | −1.33 | RHOF | ras homolog gene family, member F (in filopodia) |
| 202347_s_at | 1340 | AB022435 | 1550 | 0.000414497 | −1.16 | HIP2 | huntingtin interacting protein 2 |
| 212636_at | 1430 | AL031781 | 1543 | 0.000420707 | 1.61 | QKI | quaking homolog, KH domain RNA binding (mouse) |
| 202392_s_at | 1341 | NM_014338 | 1598 | 0.000423758 | 1.26 | PISD | phosphatidylserine decarboxylase |
| 216950_s_at | 1467 | X14355 | 1509 | 0.000437652 | 2.62 | FCGR1A | Fc fragment of IgG, high affinity Ia, receptor for (CD64) |
| 214511_x_at | 1457 | L03419 | 1515 | 0.000447516 | 2.83 | LOC440607 /// FCGR1A | Fc-gamma receptor I B2 /// Fc fragment of IgG, high affinity Ia, receptor for (C |
| 219316_s_at | 1484 | NM_017791 | 1641 | 0.000472922 | 1.68 | C14orf58 | chromosome 14 open reading frame 58 |
| 220122_at | 398 | NM_024717 | 797 | 0.000473634 | 3.36 | MCTP1 | multiple C2-domains with two transmembrane regions 1 |
| 64883_at | 1508 | AI744083 | 1669 | 0.000478581 | 1.51 | MOSPD2 | motile sperm domain containing 2 |
| 203279_at | 1354 | NM_014674 | 1644 | 0.000479669 | −1.24 | EDEM1 | ER degradation enhancer, mannosidase alpha-like 1 |
| 208891_at | 1390 | BC003143 | 1573 | 0.000483009 | 1.98 | DUSP6 | dual specificity phosphatase 6 |
| 205715_at | 1372 | NM_004334 | 1636 | 0.000490107 | 1.60 | BST1 | bone marrow stromal cell antigen 1 |
| 214085_x_at | 1451 | AI912583 | 1674 | 0.000510466 | 1.67 | HRB2 | HIV-1 rev binding protein 2 |
| 215000_s_at | 1461 | AL117593 | 1553 | 0.000515959 | 1.24 | FEZ2 | fasciculation and elongation protein zeta 2 (zygin II) |
| 202194_at | 1339 | AL117354 | 1556 | 0.000523169 | 1.36 | CGI-100 | CGI-100 protein |
| 210202_s_at | 1408 | U87558 | 1530 | 0.000532952 | −1.46 | BIN1 | bridging integrator 1 |
| 218181_s_at | 1472 | NM_017792 | 1560 | 0.000547382 | 1.13 | MAP4K4 | mitogen-activated protein kinase kinase kinase kinase 4 |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 204023_at | 1360 | NM_002916 | 1595 | 0.000553752 | −1.48 | RFC4 | replication factor C (activator 1) 4, 37 kDa |
| 207872_s_at | 1384 | NM_006863 | 1551 | 0.000561178 | 1.58 | LILRA1 | leukocyte immunoglobulin-like receptor, subfamily A (with TM domain), member 1 |
| 202878_s_at | 1349 | NM_012072 | 1622 | 0.000583921 | 1.42 | C1QR1 | complement component 1, q subcomponent, receptor 1 |
| 201285_at | 1333 | NM_013446 | 1649 | 0.000593976 | −1.21 | MKRN1 | makorin, ring finger protein, 1 /// makorin, ring finger protein, 1 |
| 211612_s_at | 1417 | U62858 | 1529 | 0.000613797 | 1.80 | IL13RA1 | interleukin 13 receptor, alpha 1 /// interleukin 13 receptor, alpha 1 |
| 219117_s_at | 1482 | NM_016594 | 1647 | 0.000616534 | −1.61 | FKBP11 | FK506 binding protein 11, 19 kDa |
| 215761_at | 1464 | AK000156 | 1557 | 0.000618215 | 2.26 | RC3 | rabconnectin-3 |
| 200800_s_at | 1328 | NM_005345 | 1642 | 0.000625103 | 1.65 | HSPA1A /// HSPA1B | heat shock 70 kDa protein 1A /// heat shock 70 kDa protein 1B |
| 202816_s_at | 1346 | AW292882 | 1679 | 0.000641212 | 1.44 | SS18 | synovial sarcoma translocation, chromosome 18 |
| 209440_at | 1397 | BC001605 | 1572 | 0.000646328 | −1.25 | PRPS1 | phosphoribosyl pyrophosphate synthetase 1 |
| 204221_x_at | 1362 | U16307 | 1587 | 0.000654803 | 1.51 | HRB2 | HIV-1 rev binding protein 2 |
| 57082_at | 1506 | AA169780 | 1659 | 0.000658787 | −1.41 | ARH | LDL receptor adaptor protein |
| 201887_at | 1338 | NM_001560 | 1589 | 0.000679598 | 1.52 | IL13RA1 | interleukin 13 receptor, alpha 1 |
| 215933_s_at | 1465 | Z21533 | 1510 | 0.000692626 | 1.47 | HHEX | hematopoietically expressed homeobox |
| 208774_at | 1389 | AV700224 | 1685 | 0.000699738 | 1.20 | CSNK1D | Casein kinase 1, delta |
| 201478_s_at | 1334 | U59151 | 1533 | 0.000707429 | −1.18 | DKC1 | dyskeratosis congenita 1, dyskerin |
| 208918_s_at | 1391 | AI334128 | 1665 | 0.000708781 | 1.38 | FLJ13052 | NAD kinase |
| 208158_s_at | 1386 | NM_018030 | 1581 | 0.000726407 | 1.37 | OSBPL1A | oxysterol binding protein-like 1A /// oxysterol binding protein-like 1A |
| 202838_at | 1348 | NM_000147 | 1651 | 0.00073801 | 1.43 | FUCA1 | fucosidase, alpha-L-1, tissue |
| 205039_s_at | 1371 | NM_006060 | 1633 | 0.000754874 | 2.05 | ZNFN1A1 | zinc finger protein, subfamily 1A, 1 (Ikaros) |
| 204834_at | 1368 | NM_006682 | 1626 | 0.000760238 | 1.74 | FGL2 | fibrinogen-like 2 |
| 200701_at | 1327 | NM_006432 | 1592 | 0.000763959 | 1.41 | NPC2 | Niemann-Pick disease, type C2 |
| 204254_s_at | 1364 | NM_000376 | 1617 | 0.00077458 | 1.64 | VDR | vitamin D (1,25-dihydroxyvitamin D3) receptor |
| 217922_at | 1470 | AL157902 | 1562 | 0.000779841 | −1.34 | MAN1A2 | Mannosidase, alpha, class 1A, member 2 |
| 218888_s_at | 1479 | NM_018092 | 1586 | 0.000801694 | 1.39 | NETO2 | neuropilin (NRP) and tolloid (TLL)-like 2 |
| 210947_s_at | 1414 | J04810 | 1514 | 0.000810544 | 1.30 | MSH3 | mutS homolog 3 (*E. coli*) |
| 208923_at | 1392 | BC005097 | 1575 | 0.000816109 | 1.41 | CYFIP1 | cytoplasmic FMR1 interacting protein 1 |
| 209429_x_at | 1396 | AF112207 | 1555 | 0.000818155 | −1.22 | — | — |
| 204566_at | 1366 | NM_003620 | 1593 | 0.000823091 | 1.67 | PPM1D | protein phosphatase 1D magnesium-dependent, delta isoform |
| 218854_at | 1478 | NM_013352 | 1630 | 0.000823847 | 1.47 | SART2 | squamous cell carcinoma antigen recognized by T cells 2 |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 213198_at | 1441 | AL117643 | 1554 | 0.000836 | 1.33 | ACVR1B | activin A receptor, type IB |
| 218642_s_at | 1476 | NM_024300 | 1618 | 0.000849263 | −1.21 | CHCHD7 | coiled-coil-helix-coiled-coil-helix domain containing 7 |
| 203645_s_at | 1358 | NM_004244 | 1632 | 0.000851877 | 1.60 | CD163 | CD163 antigen |
| 208117_s_at | 1385 | NM_031206 | 1653 | 0.000852389 | −1.32 | FLJ12525 | hypothetical protein FLJ12525 /// hypothetical protein FLJ12525 |
| 218519_at | 1474 | NM_017945 | 1594 | 0.000854014 | 1.30 | SLC35A5 | solute carrier family 35, member A5 |
| 217764_s_at | 1469 | AF183421 | 1563 | 0.000871159 | 1.30 | RAB31 | RAB31, member RAS oncogene family |
| 214765_s_at | 1459 | AK024677 | 1564 | 0.000919505 | 1.50 | ASAHL | N-acylsphingosine amidohydrolase (acid ceramidase)-like |
| 212799_at | 1432 | BE217875 | 1682 | 0.00093697 | 1.31 | — | Clone 23570 mRNA sequence |
| 204744_s_at | 1367 | NM_013417 | 1624 | 0.000961709 | −1.24 | IARS | isoleucine-tRNA synthetase |
| 218526_s_at | 1475 | NM_014185 | 1559 | 0.000964651 | −1.22 | RANGNRF | RAN guanine nucleotide release factor |
| 211139_s_at | 1415 | AF045452 | 1539 | 0.000972219 | 1.40 | NAB1 | NGFI-A binding protein 1 (EGR1 binding protein 1) |
| 213958_at | 1449 | AW134823 | 1677 | 0.000977101 | −1.39 | CD6 | CD6 antigen /// CD6 antigen |
| 221695_s_at | 1494 | AF239798 | 1558 | 0.000979214 | 1.37 | MAP3K2 | mitogen-activated protein kinase kinase kinase 2 /// mitogen-activated protein k |
| 210176_at | 1406 | AL050262 | 1549 | 0.000989413 | 1.62 | TLR1 | toll-like receptor 1 |
| 212314_at | 1427 | AB018289 | 1542 | 0.00099 | −1.34 | KIAA0746 | KIAA0746 protein |
| 209882_at | 1402 | AF084462 | 1544 | 0.000992617 | 1.42 | RIT1 | Ras-like without CAAX 1 |
| 214500_at | 1456 | AF044286 | 1541 | 0.00102256 | 1.51 | H2AFY | H2A histone family, member Y |
| 213088_s_at | 1439 | BE551340 | 1684 | 0.00104481 | −1.17 | DNAJC9 | DnaJ (Hsp40) homolog, subfamily C, member 9 |
| 200821_at | 1329 | NM_013995 | 1638 | 0.00104551 | 1.22 | LAMP2 | lysosomal-associated membrane protein 2 |
| 210732_s_at | 1411 | AF342816 | 1574 | 0.00106818 | 1.84 | LGALS8 | lectin, galactoside-binding, soluble, 8 (galectin 8) |
| 201224_s_at | 1332 | AU147713 | 1688 | 0.00107129 | −1.23 | SRRM1 | serine/arginine repetitive matrix 1 |
| 202444_s_at | 1343 | NM_006459 | 1634 | 0.00107236 | 1.72 | C10orf69 | chromosome 10 open reading frame 69 |
| 206707_x_at | 1379 | NM_015864 | 1580 | 0.00107472 | −1.24 | C6orf32 | chromosome 6 open reading frame 32 |
| 221839_s_at | 1496 | AK026088 | 1567 | 0.00107916 | −1.34 | UBAP2 | ubiquitin associated protein 2 |
| 213279_at | 1443 | AL050217 | 1547 | 0.00108194 | 1.21 | DHRS1 | dehydrogenase/reductase (SDR family) member 1 |
| 214974_x_at | 1460 | AK026546 | 1568 | 0.00109223 | 2.67 | CXCL5 | chemokine (C—X—C motif) ligand 5 |
| 209583_s_at | 1399 | AF063591 | 1570 | 0.00109644 | 1.65 | CD200 | CD200 antigen |
| 209870_s_at | 1401 | AW571582 | 1681 | 0.00112322 | −1.39 | APBA2 | amyloid beta (A4) precursor protein-binding, family A, member 2 (X11-like) |
| 201494_at | 1335 | NM_005040 | 1605 | 0.0011371 | 1.27 | PRCP | prolylcarboxypeptidase (angiotensinase C) |
| 219806_s_at | 1488 | NM_020179 | 1637 | 0.00113985 | 1.36 | FN5 | FN5 protein |
| 208651_x_at | 1387 | M58664 | 1513 | 0.00119019 | −1.38 | CD24 | CD24 antigen (small cell lung carcinoma cluster 4 antigen) |

TABLE 5-continued

MIGs discriminating between BMS and typical RRMS patients

| Affymetrix ProbSet ID | SEQ NO ID: | Representative Public ID | SEQ ID NO: | p-value BMS vs typical RRMS | Log Fold Change (BMS vs typical RRMS) | Gene Symbol | Gene description |
|---|---|---|---|---|---|---|---|
| 216191_s_at | 1466 | X72501 | 1522 | 0.00132593 | −1.84 | TRDD3 /// TRD @ | T cell receptor delta diversity 3 /// T cell receptor delta locus |
| 217143_s_at | 1468 | X06557 | 1511 | 0.00187286 | −1.83 | TRDD3 /// TRD @ | T cell receptor delta diversity 3 /// T cell receptor delta locus | vs. = versus.

TABLE 6

Genes which when included in classifiers of no more than 10 genes exhibit at least 70% correct classification rates between BMS and typical RRMS patients

| Probeset ID | SEQ ID NO: | Gene Symbol | P value (min) | BMS vs RRMS | Sequence Derived From | SEQ ID NO: | Gene Title | Full Length Ref. Sequences | SEQ ID NO: |
|---|---|---|---|---|---|---|---|---|---|
| 222204_s_at | 1498 | RRN3 | $2.1 * 10^{-8}$ | (−) | AL110238 | 1552 | RNA polymerase I transcription factor RRN3 | NM_018427 | 1010 |
| 221714_s_at | 1495 | LOC94431 | | | BC006441 | 1579 | similar to RNA polymerase I transcription factor RRN3 | NM_145237 | 1156 |
| 211615_s_at | 1418 | LRPPRC | $2.4 * 10^{-8}$ | (−) | M92439 | 1512 | leucine-rich PPR-motif containing protein | NM_133259 | 1065 |
| 211971_s_at | 204 | LRPPRC | | | AI653608 | 606 | leucine-rich PPR motif containing protein | NM_133259 | 1065 |
| 218258_at | 173 | POLR1D | $1.9 * 10^{-6}$ | (−) | NM_015972 | 984 | hypothetical protein MGC9850 | NM_152705 | 1695 |
| 205789_at | 1373 | CD1D | $4.3 * 10^{-6}$ | (+) | NM_001766 | 1627 | CD1D antigen, d polypeptide | NM_001766 | 1627 |
| 212999_x_at | 1437 | HLA-DQB1 | $9.9 * 10^{-6}$ | (+) | AW276186 | 1678 | major histocompatibility complex, class II, DQ beta 1 precursor | NM_002123 | 1699 |
| 209823_x_at | 1400 | HLA-DQB1 | | | M17955 | 1518 | major histocompatibility complex, class II, DQ beta 1 precursor | NM_002123 | 1699 |
| 209480_at | 1398 | HLA-DQB1 | | | M16276 | 1521 | major histocompatibility complex, class II, DQ beta 1 precursor | NM_002123 | 1699 |
| 211656_x_at | 1420 | HLA-DQB1 | | | M32577 | 1520 | major histocompatibility complex, class II, DQ beta 1 precursor | NM_002123 | 1699 |
| 211654_x_at | 1419 | HLA-DQB1 | | | M17565 | 1519 | major histocompatibility complex, class II, DQ beta 1 precursor | NM_002123 | 1699 |
| 210747_at | 1412 | HLA-DQB1 | | | M24364 | 1525 | major histocompatibility complex, class II, DQ beta 1 precursor | NM_002123 | 1699 |

TABLE 6-continued

Genes which when included in classifiers of no more than 10 genes exhibit at least 70% correct classification rates between BMS and typical RRMS patients

| Probeset ID | SEQ ID NO: | Gene Symbol | P value (min) | BMS vs RRMS | Sequence Derived From | SEQ ID NO: | Gene Title | Full Length Ref. Sequences | SEQ ID NO: |
|---|---|---|---|---|---|---|---|---|---|
| 206584_at | 1378 | LY96 | 5.8 * 10−6 | (+) | NM_015364 | 1650 | lymphocyte antigen 96; // MD-2 protein | NM_015364 | 1650 |
| 207359_at | 1383 | CAMKK2 | 6.1 * 10−6 | (+) | NM_006549 | 1590 | calcium/calmodulin-dependent protein kinase kinase 2, beta isoform 1 | NM_006549 | 1590 |
| 214209_s_at | 1452 | CAMKK2 | | | BE504895 | 1683 | calcium/calmodulin-dependent protein kinase kinase 2, beta isoform 1 | NM_006549 | 1590 |
| 213812_s_at | 1446 | CAMKK2 | | | AK024748 | 1565 | calcium/calmodulin-dependent protein kinase kinase 2, beta isoform 1 | NM_006549 | 1590 |
| 210787_s_at | 1413 | CAMKK2 | | | AF140507 | 1546 | calcium/calmodulin-dependent protein kinase kinase 2, beta isoform 1 | NM_006549 | 1590 |
| 212252_at | 1425 | CAMKK2 | | | AA181179 | 1660 | calcium/calmodulin-dependent protein kinase kinase 2, beta isoform 1 | NM_006549 | 1590 |
| 214643_x_at | 1458 | BIN1 | 2.2 * 10−6 | (−) | BG034080 | 1690 | bridging integrator 1 isoform 8 | NM_004305 // NM_139343 | 1693 //1694 |
| 210202_s_at | 1408 | BIN1 | | | U87558 | 1530 | bridging integrator 1 isoform 8 | NM_004305 // NM_139343 // | 1693 //1694 |
| 214439_x_at | 1453 | BIN1 | | | AF043899 | 1535 | bridging integrator 1 isoform 8 | NM_004305 // NM_139343 // | 1693 //1694 |
| 202931_x_at | 1350 | BIN1 | | | NM_004305 | 1584 | bridging integrator 1 isoform 8 | NM_004305 // NM_139343 // | 1693 //1694 |
| 210201_x_at | 1407 | BIN1 | | | AF001383 | 1531 | bridging integrator 1 isoform 8 | NM_004305 // NM_139343 // | 1693 //1694 |
| 214450_at | 1454 | CTSW | 3.8 * 10−6 | (−) | NM_001335 | 1629 | cathepsin W preproprotein | NM_001335 | 1629 |
| 214470_at | 1455 | KLRB1 | 3.8 * 10−6 | (−) | NM_002258 | 1615 | killer cell lectin-like receptor subfamily B, member 1 | NM_002258 | 1615 |
| 212748_at | 1431 | MKL1 | 7.9 * 10−9 | (+) | AB037859 | 1583 | megakaryoblastic leukemia (translocation) 1 | NM_020831 | 1696 |
| 209072_at | 1393 | MBP | 2.7 * 10−5 | (−) | M13577 | 1517 | myelin basic protein | NM_002385 | 1620 |
| 210136_at | 1404 | MBP | | | AW070431 | 1676 | myelin basic protein | NM_002385 | 1620 |
| 207323_s_at | 1382 | MBP | | | NM_002385 | 1620 | myelin basic protein | NM_002385 | 1620 |
| 212978_at | 1435 | TA-LRRP | 4.1 * 10−5 | (+) | AU146004 | 1686 | T-cell activation leucine repeat-rich protein | NM_015350 | 1700 |
| 212976_at | 1434 | TA-LRRP | | | R41498 | 1655 | T-cell activation leucine repeat-rich protein | NM_015350 | 1700 |
| 117_at | 1325 | HSPA6 | 8.9 * 10−5 | (+) | X51757 | 1692 | heat shock 70 kDa protein 6 (HSP70B') | NM_002155 | 1609 |

TABLE 6-continued

Genes which when included in classifiers of no more than 10 genes exhibit at least 70% correct classification rates between BMS and typical RRMS patients

| Probeset ID | SEQ ID NO: | Gene Symbol | P value (min) | BMS vs RRMS | Sequence Derived From | SEQ ID NO: | Gene Title | Full Length Ref. Sequences | SEQ ID NO: |
|---|---|---|---|---|---|---|---|---|---|
| 213418_at | 1445 | HSPA6 | | | NM_002155 | 1609 | heat shock 70 kDa protein 6 (HSP70B') | NM_002155 | 1609 |
| 200610_s_at | 1326 | NCL | 8.9 * 10−5 | (−) | NM_005381 | 1613 | nucleolin | NM_005381 | 1613 |
| 216191_s_at | 1466 | TRD @ | 3.7 * 10−4 | (−) | X72501 | 1522 | T cell receptor delta locus | — | #N/A |
| 217143_s_at | 1468 | TRD @ | | | X06557 | 1511 | T cell receptor delta locus | — | #N/A |
| 213830_at | 1447 | TRD @ | | | AW007751 | 1675 | T cell receptor delta locus | — | #N/A |
| 213005_s_at | 1438 | KANK | 3.7 * 10−4 | (+) | D79994 | 1614 | kidney ankyrin repeat-containing protein | NM_015158 // NM_153186 | 1698 //1697 |

Presented are 38 gene transcripts which correspond for 17 human genes which classify BMS and typical RRMS patients.
Genes given by the gene name and description, the Affymetrix probeset identification number, and a representative GenBank Accession numbers.
The (−) sign means that the polynucleotide is downregulated (decreased in level) in BMS as compared to typical RRMS subjects;
and the (+) sign means that the polynucleotide is upregulated (increased in level) in BMS as compared to RRMS subjects.

Examples of classifiers are presented as following: NCL, MKL1, CTSW, KLRB1 and LRPPRC which results in correct classification rate of 79% of BMS and typical RRMS; and NCL, MKL1, CTSW, KLRB1, POLR1D, CD1D, and CAMKK2 which results in correct classification rate of 77% of BMS and typical RRMS.

Example 3

Testing the Effect of an Anti MS Drug in Experimental Allergic Encephalomyelitis (EAE)—Animal MS Model Animal Model for Multiple Sclerosis—

EAE is induced in female Lewis rats (N=15; 6-8 weeks old, body weight 180-200 g) by hind footpad subcutaneous inoculation with emulsion of 25 mg guinea-pig MBP (myelin basic protein) in CFA containing 40 mg of *Mycobacterium tuberculosis* (Difco, Detroit, Mich.) in 0.1 ml oil. Control rats (N=15) are injected with the same emulsion where saline solution replaces MBP. The EAE is scored as follows: 0—No obvious changes in motor function on of the rats in comparison to non-immunized rats; 1—Limp tail; 2—Limp tail and weakness of hind legs; 3—Limp tail and complete paralysis of hind legs, or limp tail with paralysis of one front and one hind leg. Or all of: walking only along the edges of the cage, pushing against the cage wall, pushing against the cage wall, spinning when picked up by the tail; 4—Limp tail, complete hind leg and partial front leg paralysis; 5—Complete hind and complete front leg paralysis, no movement around the cage, or mouse is spontaneously rolling in the cage, mouse is found dead due to paralysis.

Treatment with an Anti MS Drug or with an Agent which Downregulates at Least One Gene of the RNA Polymerase Pathway—

A therapeutically effective amount of a drug or an agent which downregulates the expression level of a gene involved in the RNA polymerase I pathway (e.g., TPT) is administered to the animal on the day of EAE induction and blood samples are drawn before and after treatment, at predetermined time points which include baseline=Time 0, Day 12—peak disease, Day 17 and day 21.

Testing the Level of Expression of Genes Involved in the RNA Polymerase I Pathway—

Blood samples, obtained from the control and treated animals, are tested using Q-RT-PCR for bio-markers of benign multiple sclerosis (e.g., $RRN_3$, $POLR_1D$ and LRPPRC). Control animals are compared to animals on the peak of EAE disease and to animals treated by the anti MS drug (e.g., TPT).

Example 4

In Vitro Testing Efficacy of a Drug In Vitro Using Cells of a Multiple Sclerosis Subject Peripheral blood samples are obtained from female subjects with typical RRMS disease course. All patients are free of immunomodulatory or corticosteroid treatments at least 30 days before blood withdrawal. PBMC are extracted from peripheral blood, separated by Ficoll-Hypaque gradient. 15 ml of peripheral blood from patients is diluted 1:1 with Phosphate Buffered Saline (PBS) (without $Ca^{2+}/Mg^{2+}$). Blood samples are underlied with 10 ml of Ficoll-Lymphoprep (Axis Chield, Norway) and spinned (Eppendorf centrifuge, Germany) at 2300 RPM for 30 minutes. PBMCs are collected, washed with PBS and counted and incubated at 37° C. in a humidified $CO_2$ incubator with or without anti MS drugs. After incubation, total RNA is extracted using both Trizol (Invitrogen, USA) and Phase-Lock-Gel columns (Eppendorf, Germany) including a DNase digestion step. RNA integrity is assessed by RNA Experion automated electrophoresis system.

Treatment with an Anti MS Drug or with an Agent which Downregulates at Least One Gene of the RNA Polymerase Pathway—

A therapeutically effective amount of a drug or an agent which downregulates the expression level of a gene involved in the RNA polymerase I pathway (e.g., TPT) is incubated during 3 hours with the PBMC (of the subject having typical RRMS) and compared with PBMC (of the subject having typical RRMS) incubated during 3 hours without drug or with placebo excluding therapeutic component.

Testing the Level of Expression of Genes Involved in the RNA Polymerase I Pathway—

Total RNA samples, obtained from PBMC of a subject having typical RRMS trayed in-vitro with anti-RNA polymerase I agents (e.g. TPT), are tested using Q-RT-PCR for bio-markers of benign multiple sclerosis (e.g., $RRN_3$, $POLR_1D$ and LRPPRC). The results compared with PBMC from same patients incubated without drag or with placebo.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES

Additional References are Cited in Text

1. Hirschler-Laszkiewicz I, Cavanaugh A H, Mirza A et al. Rrn3 becomes inactivated in the process of ribosomal DNA transcription. J Biol Chem. 2003; 278:18953-18959;
2. Miller G, Panov K I, Friedrich J K et al. hRRN3 is essential in the SL1-mediated recruitment of RNA Polymerase I to rRNA gene promoters. Embo J. 2001; 20:1373-1382;
3. Achiron A, Gurevich M, Snir Y et al Zinc-ion binding and cytokine activity regulation pathways predicts outcome in relapsing-remitting multiple sclerosis. Clin Exp Immunol. 2007; 149:235-242;
4. Mootha V K, Lepage P, Miller K et al. Identification of a gene causing human cytochrome c oxidase deficiency by integrative genomics. Proc Natl Acad Sci USA. 2003; 100:605-610;
5. Bouwmeester T, Bauch A, Ruffner H et al. A physical and functional map of the human TNF-alpha/NF-kappa B signal transduction pathway. Nat Cell Biol. 2004; 6:97-105;
6. Leuenroth S J, Crews C M. Triptolide-induced transcriptional arrest is associated with changes in nuclear substructure. Cancer Res. 2008; 68:5257-5266;
7. Liu Y, Chen Y, Lamb J R, Tam P K. Triptolide, a component of Chinese herbal medicine, modulates the functional phenotype of dendritic cells. Transplantation. 2007; 84:1517-1526;
8. Wang Y, Mei Y, Feng D, Xu L. Triptolide modulates T-cell inflammatory responses and ameliorates experimental autoimmune encephalomyelitis. J Neurosci Res. 2008; 86:2441-2449;
9. Pittock S J, Rodriguez M. Benign multiple sclerosis: a distinct clinical entity with therapeutic implications. Curr Top Microbiol Immunol. 2008; 318:1-17;
10. L Costelloe, A Thompson, C Walsh, N Tubridy, and M Hutchinson Long-term clinical relevance of criteria for designating multiple sclerosis as benign after 10 years of disease J. Neurol. Neurosurg. Psychiatry, November 2008; 79: 1245-1248.

SEQUENCE LISTING (1700 sequences)

SEQ ID NO: 1 - DNA, 506 bp, Homo sapiens
ttcctacaagtgcaattgccggcttaaagggtactatgtgtgttttacgtattgagagatattggcaaattggccttaaagagttctattgactatttatagttctactaatgatttatacagtattttgttaacacggccttttggtctggaaataattacactgtaagacagtacagttgaaatatcaaagaaattaaaacaaagttaggtatgtcataattatatgaaatatgtgtagacactagtccattttatcatttgctaccataaaatatgcacacatctgttatacaaagttaaaatttatcaaaacatagaaacacagaacatgcatagcataatttgtggttgagaaatgtaaacaagtgtaaagatgcagtattattacgcatataataactgtagtccatgctgtactactgtaataattttgtagccacctcttgttgctgttgtgactcactcagtgttgacactcatcaccttcttgtgaacagttcatc

SEQ ID NO: 2 - DNA, 541 bp, Homo sapiens
tcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctgaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggt

SEQ ID NO: 3 - DNA, 544 bp, Homo sapiens
aagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttctttttttttttttttttttttttacacaagacgtggttaaagaactgtttgtgactgaagttcctcatagtgtcattggtatgagagaggatcatggacaatgaataaatgcacacttctgactataattttgagcagtgaaggaaggatgactgcctgttacacag

SEQ ID NO: 4 - DNA, 492 bp, Homo sapiens
gttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctg

SEQ ID NO: 5 - DNA, 489 bp, Homo sapiens
cgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagac

SEQ ID NO: 6 - DNA, 293 bp, Homo sapiens
cttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatagatctaacttcccagggggcaggcacttactggtatttacctcctgagtgttttg

SEQ ID NO: 7 - DNA, 420 bp, Homo sapiens
taagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagcgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaa

SEQ ID NO: 8 - DNA, 549 bp, Homo sapiens
  misc_feature (237)..(237): n is a, c, g, or t
  misc_feature (302)..(302): n is a, c, g, or t
  misc_feature (310)..(310): n is a, c, g, or t
  misc_feature (315)..(315): n is a, c, g, or t
  misc_feature (322)..(322): n is a, c, g, or t
cacacaggtacaactagggtccagctgtgaagcgagatattttggacagcaaatgggaagggtatttatactgaatcatgtatccagtcatggtccagagatcacagctgagagtggtgcttattccttatgtctataacaacataagcaatactataatgaccactaaaacactaggcccaggtatgcagttgaacatggtctccctctgccctcccttttattctctctctcttntcttacgtctttgcttgtttttatttttctctccctccctgactccctccctccatccatccttncccccccncctcncccgctncccccccccatccattctccttccttgttttcctccttcctgccttgcttgtctctctctttctttcctttttgggtacataatcagaatactttttccacaaaatcatttcgatataatttttctctatttgttcatgccaacatttatacagctagtttaattgttcagttttcatttttacattttggaaatgtgttgtattactttgttttgcttcatatctg

SEQ ID NO: 9 - DNA, 462 bp, Homo sapiens
ggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccaca

SEQ ID NO: 10 - DNA, 537 bp, Homo sapiens
  misc_feature (329)..(329): n is a, c, g, or t
  misc_feature (364)..(364): n is a, c, g, or t
  misc_feature (367)..(367): n is a, c, g, or t
  misc_feature (375)..(375): n is a, c, g, or t
  misc_feature (380)..(380): n is a, c, g, or t
  misc_feature (388)..(388): n is a, c, g, or t
  misc_feature (457)..(457): n is a, c, g, or t
tacaactatgtatctctttcttttaatacacttcaaattcttgctatataccataatatacttaaccatatctccatgatggacatttaaattgtttggagtttttggctattacaagcaatattgcagtaaacctgtttgtataatttttctgcacatactcctgtagaattactagaagtgccatttctgaataaaaaattgactagtattaccaagttaccctataaaatgcctaatcagtttatattctaacagggtatgaaagtgcccatttctagccaacattagataccctcagtctcatacttaagtattttttttccccnaatcagttagatgaaaggtgatttttttaactaanaantttctgantgaantttctgantgttccgtagcatttttttttcctaaggtattttagccatccttatttcttcttttcagaatggtatantcctgttgtatatccattttgatatcttaatgatttataaccctttataaaaatagaatgagtgctaatcctttgttatg

SEQ ID NO: 11 - DNA, 394 bp, Homo sapiens
acaggcctgccgatttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgt

SEQ ID NO: 12 - DNA, 496 bp, Homo sapiens
aagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgc

SEQ ID NO: 13 - DNA, 510 bp, Homo sapiens
cacccagaagcgccgaaaggatgacatggagctgagtgacttccttgcccttccacctcctcctcctaatattcactctgggctcttcttcccttcccacccctcactcagctgctcgtggtggcaggaggtatgtctgacaggacagaagcaagctccccatcatcttgtcctagagtgggcgtcaccttggagcttctcttccttccgcctctgttcctcttctggagcctttgcctcccatctcttatctccttgatataattttgaacttgacctactttaaacttttttgctctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataa

SEQ ID NO: 14 - DNA, 527 bp, Homo sapiens
gtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattgctataaaaaatgtcaataagattgtacaaggaaaattagagaaagtcacatttagggtttattttttacacttggccagtaaaatagggtaaatcctattagaaattttttaaagaactttttttaagtttcctaaatctgtgtgtgtattgtgaagtggt

SEQ ID NO: 15 - DNA, 444 bp, Homo sapiens
aggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctc

SEQ ID NO: 16 - DNA, 453 bp, Homo sapiens
  misc_feature (250)..(250): n is a, c, g, or t
aacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcangcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtcca

SEQ ID NO: 17 - DNA, 534 bp, Homo sapiens
aacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagc

SEQ ID NO: 18 - DNA, 310 bp, Homo sapiens
tttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctg

SEQ ID NO: 19 - DNA, 520 bp, Homo sapiens
  misc_feature (132)..(132): n is a, c, g, or t
agaactcatgagccttgtgtctgggctgctgcagccagtccctgagagacgcaccaccttggagaagctggtgacagacccgtgggtaacacagcctgtgaatcttgctgactatacatgggaagaggtgtntcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctag

SEQ ID NO: 20 - DNA, 502 bp, Homo sapiens
tcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgtgctctgcttttctcctcccccatcccttcctcattccttcaaccccttcccctaaccaccaccaccaccaccttttaggaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaatta

SEQ ID NO: 21 - DNA, 434 bp, Homo sapiens
cccagctcagctttgtggcttggattcacaccatataaaatcttcaacagacattcattcctttgttcagaacacacaaccttctaacgtgaacctccaattttctaaattcattctttttctacttcacctgaaaccacagatccatggcacttagtttctctgtaacagcagctctaccatggtgtccagaaattttagcccctactatcaagaacaaaacatccttgtacatgtttatacatctttttgagtaggagttttccaccagttgcagggattccctgagtctagagtaatgccacaatgctgctcccttttactcctttctaagcatttctgtcagggagaagacttagattcagttgttcactttaacattttccttagatactctcttagaaaagttgtattctgcgcacttctgttatgaa

SEQ ID NO: 22 - DNA, 518 bp, Homo sapiens
  misc_feature (27)..(27): n is a, c, g, or t
ttcattgcctttttcacctaagcatanggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattca

SEQ ID NO: 23 - DNA, 324 bp, Homo sapiens
aaatgtgggaaggcatatggtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgc

SEQ ID NO: 24 - DNA, 492 bp, Homo sapiens
aatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcct

SEQ ID NO: 25 - DNA, 531 bp, Homo sapiens
gtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggt

SEQ ID NO: 26 - DNA, 312 bp, Homo sapiens
  misc_feature (173)..(173): n is a, c, g, or t
  misc_feature (181)..(181): n is a, c, g, or t
  misc_feature (191)..(191): n is a, c, g, or t
ggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagccnaagcagtnccagaggccntcagaaagggattagggtagatgattgcaactgaaacacaatcttctttctttgccagggtattttgggggttttgccccaaaatataccctgggcatagcattactgcagtcttggatgt

SEQ ID NO: 27 - DNA, 255 bp, Homo sapiens
gaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacatt

SEQ ID NO: 28 - DNA, 365 bp, Homo sapiens
agggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaac

SEQ ID NO: 29 - DNA, 265 bp, Homo sapiens
aatatagtggtgatccctcaattggtaacatatcagatgaaatggccaaaactgcacagtggaaggcactttccatgaatactgagaatgccaaagtaaccagatctaacatgagtcctgataaacctgtgagtgtgaaataagtttgagatgaaccaagaaagaaatacgtggagctgaaacttcatatagaatggaaccaagaggcatatacatatagatatatacatatgtaagggtgcgatcatggcactatatatagaat

SEQ ID NO: 30 - DNA, 495 bp, Homo sapiens
gttatgtcgtggggctcccattagctgctggattccagcctcataagggtggagctctcccgtgtcagctcgtagcacaaaaggtgaagagcctgctgtggggccagggcttcccagattacgtggccccttttggaaattcccaagcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcgggcttcagagctccaccagccatcaatgccaggctgccctttaacttcttcttcccgtttgtttgacaat

SEQ ID NO: 31 - DNA, 400 bp, Homo sapiens
  misc_feature (108)..(108): n is a, c, g, or t
  misc_feature (110)..(110): n is a, c, g, or t
  misc_feature (118)..(118): n is a, c, g, or t
  misc_feature (126)..(126): n is a, c, g, or t
  misc_feature (128)..(128): n is a, c, g, or t
  misc_feature (135)..(135): n is a, c, g, or t
  misc_feature (142)..(142): n is a, c, g, or t
  misc_feature (145)..(145): n is a, c, g, or t
  misc_feature (179)..(179): n is a, c, g, or t
  misc_feature (191)..(191): n is a, c, g, or t
  misc_feature (207)..(207): n is a, c, g, or t
  misc_feature (228)..(228): n is a, c, g, or t
  misc_feature (312)..(312): n is a, c, g, or t
actcattatgatccaccacgaaagcttatggccatgcagcggccaggtccttatgacagacctggggctggtagagggtataacagcattggcagaggagctggcttngngaggatgnggcgtggngnttatggnggaggcntantggaggctatgatgattacaatggctataatgantggctatggatntgggtcagatagattnggaagaggtaaggtaagaatngaatttctcagttgaaggatgcttacactcttgtccatctagacctcaattactgtttttcaggaatgtctgatcacagatacngggatggtggctctactttccagagcacaacaggacactgtgtacacatgcggggattaccttacagagctactgagaatgacattta

SEQ ID NO: 32 - DNA, 464 bp, Homo sapiens
gactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccac

SEQ ID NO: 33 - DNA, 303 bp, Homo sapiens
ggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgta

SEQ ID NO: 34 - DNA, 363 bp, Homo sapiens
  misc_feature (37)..(37): n is a, c, g, or t
  misc_feature (55)..(55): n is a, c, g, or t
  misc_feature (100)..(100): n is a, c, g, or t
  misc_feature (105)..(105): n is a, c, g, or t
  misc_feature (120)..(120): n is a, c, g, or t
  misc_feature (133)..(133): n is a, c, g, or t
  misc_feature (155)..(155): n is a, c, g, or t
  misc_feature (171)..(171): n is a, c, g, or t
  misc_feature (175)..(175): n is a, c, g, or t
  misc_feature (182)..(182): n is a, c, g, or t
ctacactcacctgcactaacagagtggccgtcctaanctcgggcctgctgcgcanacgtccatcacgttagctgtcccacatcacaagactatgccattnggggnagttgtgtttcaacnggaaagtgctgtncttaaactaaatgtgcaatagnaaggtgatgttgccancctnaccgtcntttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagt

SEQ ID NO: 35 - DNA, 454 bp, Homo sapiens
cacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcctgtgtgcccaggcctcgggggtctcagagccgcctctcacccccgaccctccacccaggggtctccccgtcgggagtggaggcgttggtcctggaagctga

SEQ ID NO: 36 - DNA, 324 bp, Homo sapiens
caactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactgtgttgcccatgctggtcttgaactcctggcttcaatcactcctcccacctcggcctcccaaattgctgggattacaggcataagccactgtgcctggctctattaaaatttaa

SEQ ID NO: 37 - DNA, 482 bp, Homo sapiens
gagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagttgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaa

SEQ ID NO: 38 - DNA, 514 bp, Homo sapiens
  misc_feature (162)..(162): n is a, c, g, or t
  misc_feature (195)..(195): n is a, c, g, or t
  misc_feature (208)..(208): n is a, c, g, or t
  misc_feature (218)..(218): n is a, c, g, or t
  misc_feature (223)..(223): n is a, c, g, or t
  misc_feature (241)..(241): n is a, c, g, or t
  misc_feature (244)..(244): n is a, c, g, or t
  misc_feature (248)..(248): n is a, c, g, or t
  misc_feature (250)..(252): n is a, c, g, or t
  misc_feature (254)..(256): n is a, c, g, or t
  misc_feature (258)..(259): n is a, c, g, or t
gatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccancctgtgataccttcactctaattttactttctnaggaagttttctntaatagttanttggngataattattaatactgntgngaantnnntnnnannaagaaatcctcagaggaaattacccagtatattcaaagctacaagggatttgttgacataacggtctgttttcaaggcagtttccggaaacagtgaccctgagaaggcttcctcctgagtatgcataaacattcacagcttgcatgcgtgtgtgtgtgtgtgtgtgtgtgtgtgtgtatgtttgcttgcactgcataaaaacaattgcaacatcaacagaaataaaaattaaaggaataattctcctccgactct

SEQ ID NO: 39 - DNA, 549 bp, Homo sapiens
aagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtgg

SEQ ID NO: 40 - DNA, 504 bp, Homo sapiens
gggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcat

SEQ ID NO: 41 - DNA, 539 bp, Homo sapiens
aaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgag

SEQ ID NO: 42 - DNA, 360 bp, Homo sapiens
ttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctt

SEQ ID NO: 43 - DNA, 484 bp, Homo sapiens
aatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaat

SEQ ID NO: 44 - DNA, 361 bp, Homo sapiens
ggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaag

SEQ ID NO: 45 - DNA, 499 bp, Homo sapiens
  misc_feature (58)..(58): n is a, c, g, or t
  misc_feature (302)..(302): n is a, c, g, or t
atggtggaattgctcagtgctcccataaatatacatttataattttcatttgccacanggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatnacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaat

SEQ ID NO: 46 - DNA, 455 bp, Homo sapiens
taagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttg

SEQ ID NO: 47 - DNA, 571 bp, Homo sapiens
aaggaccagagctcagatgctacccctggcccggcatcatctcttactgcgctgctcctcatagctgtcctcctgggccccatctatgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggtt

SEQ ID NO: 48 - DNA, 508 bp, Homo sapiens
tctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgag

SEQ ID NO: 49 - DNA, 266 bp, Homo sapiens
tctcaacttattcccttcaattcaagtaacaggaaacaagattttggtgaagcagtcgcccatgcttgtagcgtacgacaatgcggtcaaccttagctggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatga

SEQ ID NO: 50 - DNA, 493 bp, Homo sapiens
tagccccaggaacccttgaggttcttcttcacaaggctgagagtgcttccttcttgaagacgagtgtcattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagtttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaatt

SEQ ID NO: 51 - DNA, 547 bp, Homo sapiens
  misc_feature (85)..(85): n is a, c, g, or t
  misc_feature (426)..(426): n is a, c, g, or t
  misc_feature (446)..(446): n is a, c, g, or t
  misc_feature (456)..(456): n is a, c, g, or t
ggaccgtgctgacctcaataaggacaagcctgtcattcctgctgctgccctagctggctacacaggcagtggaccaatccagctntggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccntgctgagaccttccaaggancagccgtgtnggttggactctgaattttgaattgttattctattttttattttccagaactcattttttaccttcaggggtgggagctaagtcagttgcag

SEQ ID NO: 52 - DNA, 412 bp, Homo sapiens
  misc_feature (52)..(52): n is a, c, g, or t
  misc_feature (115)..(116): n is a, c, g, or t
  misc_feature (282)..(282): n is a, c, g, or t
  misc_feature (292)..(292): n is a, c, g, or t
  misc_feature (302)..(302): n is a, c, g, or t
agcacagggcaccaactggacagaggcctccggtcagcctcactctgactgnaaccccctctcactggacagcatcacctggacacagagcctcacctagtctgtgtcccatggnncacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcangcgctccgcngtgcctagcncccgctcagccagggcagcctgcagcggagcttggagccagcagcttctcatctcttggcctcgggaaatgtagctggagtcatcatttagcagagcacggtgtccctgg

SEQ ID NO: 53 - DNA, 506 bp, Homo sapiens
  misc_feature (309)..(309): n is a, c, g, or t
  misc_feature (355)..(355): n is a, c, g, or t
gagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctntgcctctctatggcccactttgaccactaacaacatcagaattatntacatcaatttcattgagccattggtgaatgaagacacccatcacttgtcatgttggtttccaacagtcctttcgattatcctttattttcttatcctcccttctcttgtttcttttatttataagttaccattcctagtttctttgtact

SEQ ID NO: 54 - DNA, 537 bp, Homo sapiens
  misc_feature (233)..(233): n is a, c, g, or t
  misc_feature (236)..(236): n is a, c, g, or t
tggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagcnggncacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctcc

SEQ ID NO: 55 - DNA, 537 bp, Homo sapiens
aagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagca

SEQ ID NO: 56 - DNA, 407 bp, Homo sapiens
ctgccctgtacatgctagttcaacagaaaggaatggcctttcaccttctcctggtggcaggcaagcagatgtcctctgcggagataccgccagctccccaggacgcagactgactcctgtttgctcgctggaccaaccccaggcagaaggtggaaggtgggaacagaggtttagctgcaggacatgtattcccattgcaccgagacctaactgccgctcagagtgtagaccgagatggtgcagatgcctgcagtgccattaaaatgtgggtgaaggtgacatcaggattatgtgccccaggccgggctcagtggctcacacctgtaatcccagcactttgggaggccaaggtgggcggatcacctgaggtcaggagtttgcgacaagcctgccaacaagctgaaacc

SEQ ID NO: 57 - DNA, 416 bp, Homo sapiens
  misc_feature (153)..(153): n is a, c, g, or t
  misc_feature (155)..(156): n is a, c, g, or t
  misc_feature (163)..(163): n is a, c, g, or t
  misc_feature (165)..(166): n is a, c, g, or t
aactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataantnnggaatangnntttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatcca

SEQ ID NO: 58 - DNA, 476 bp, Homo sapiens
ggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagc

SEQ ID NO: 59 - DNA, 507 bp, Homo sapiens
  misc_feature (432)..(435): n is a, c, g, or t
agtacactgccttatgtgaaatttggtcatggaatgtactcataagagataagtgctgacagttaaaaagatgagtatggcccttccctggagatgcttaacagtctagtagaaaataaacataacatttttttcaattcccatgagatactatgttggcatgagaggcatatttttacagaattttgaagacgacttatttaaattagttttgagttttggttctattactacaaacaaaatgagtaattattgtgtcatatggttatttagacatctaagagtgaacaaaaatgataagtgtgcttagagaattaaatatctccactgaggcatggtagcaccacaggaaagatgtgtcccgtagcagatatgagataacttagctattggaaataatctaggactaaagtaattgatcaaaacaaaaannnnggggaaataactgaacatgtagcccaactccagagctttgcaaatttataagcttaagtggtcgtcacgcct

SEQ ID NO: 60 - DNA, 437 bp, Homo sapiens
gcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccct

SEQ ID NO: 61 - DNA, 355 bp, Homo sapiens
  misc_feature (265)..(265): n is a, c, g, or t
  misc_feature (276)..(276): n is a, c, g, or t
atgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattgnagacggagagnacgacgagacggaggagggcgcaggggacatgagccaggtgaagcccgtgctgtccaaggcagagcgcagtcacatcat

SEQ ID NO: 62 - DNA, 296 bp, Homo sapiens
gatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattt

SEQ ID NO: 63 - DNA, 456 bp, Homo sapiens
tctaatctcaaggccccttaggcttatgaattcaaaaaaaaaatagaagaaatgaacaaaaacataaatcacagtttgttattaagtaatatctgaaatgaattagaaagaaaccataagccttaacaatactccaatcacagttaaattaatttagacagaaaagcaaatagcaattgacttgaaaataagaagtggggccgaaggtggatacaagaaatccaggagggctaagatatatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcaga

SEQ ID NO: 64 - DNA, 542 bp, Homo sapiens
ggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaa

SEQ ID NO: 65 - DNA, 527 bp, Homo sapiens
gattgatcactggacacattcagaaacagtatcaatgacagactttgatatacaatatacttaccttgggggtcatgtatgtttgtctgcacatgcaagaaatggttcaaaacaatgggggacctatgcagaagctataagtgcatgtggtcaacacaggttatgtagattccaaggatgcaaatatcttagtgacataaatataacaagatataacataaattgcagagagaatagggcttgcaatgaacttttccattgtcagtgtgatcctggttatgcacctccagattgtgagccgccaatatcatcaccaggaggagtgtttaatgatggatttaggcttacggtagaaaaaagtgtacccttgtttccaaaacgacgtgctgctcctaaaaacaatggtcttttgatcagtttctacatttctttttcacctttgctcattttaattgctattgttagtcttaaatggaataaaatgaagagattttggagcaaaggcggaacaataagcagcatatcta

SEQ ID NO: 66 - DNA, 276 bp, Homo sapiens
ttctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttcca

SEQ ID NO: 67 - DNA, 521 bp, Homo sapiens
  misc_feature (85)..(85): n is a, c, g, or t
  misc_feature (172)..(172): n is a, c, g, or t
tcaccaaccccacctgtgagattgtggatgagaagactgtcgtggtccacaccagccagactccagttgaccctcaggagggcancaccccccttatgggccaggccgggactcctggggcctgagcccccccagtgggcaggagcccatgcagacactggtgcaggacagnccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacact

SEQ ID NO: 68 - DNA, 447 bp, Homo sapiens
  misc_feature (335)..(336): n is a, c, g, or t
gtgcctggatgttactcttacccaggcgctgctttaagctcttctgcttaagttttaatgctgcctggacagagggtctattctccatctgctgggccagtcttctgtttctggcactggctagctgctgttgttgctgcatcgaagcccgaatattcactggcgtcggctgtttgttcttcagcatattagtaaagcgctcatttagagacatcttggtggtgctttttagcacaactttcggcgctgactgtgcagccatcttcgaatcccgagaatcgaaggaaacagacgccagtgctcctcccggggctgccaccacggctccggcaggnnggccggggaccggccgaacctgagttgacggtggaggggctcgggttagctagatgggcggttggttagatgcgtaagcggtagtatgcgagctcagttcgttgttgctgg

SEQ ID NO: 69 - DNA, 481 bp, Homo sapiens
ccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatg

SEQ ID NO: 70 - DNA, 287 bp, Homo sapiens
  misc_feature (103)..(103): n is a, c, g, or t
  misc_feature (193)..(193): n is a, c, g, or t
  misc_feature (195)..(195): n is a, c, g, or t
  misc_feature (200)..(200): n is a, c, g, or t
gaagtgaatctctagggcgagttgagtttgagcatagtcacctctaaaatgagatggcctctgcggacacatgaaagggtacttcagcttaccaaaatccagnacttaataggttgaaagctaaccatatctgaaagtagactttcctttatacaattattttttttcagactattattacttttaattgaangngaaancgtaacactaagtatgcagtctattatgaaatcatgttgacaactaagtttcttttcaaaatttttgaggccgagcacttctgtaat

SEQ ID NO: 71 - DNA, 213 bp, Homo sapiens
tcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagac

SEQ ID NO: 72 - DNA, 496 bp, Homo sapiens
gcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagca

SEQ ID NO: 73 - DNA, 467 bp, Homo sapiens
ggatccaagtaatcctgccatcatcaggcaggctgctggaaattatattggaagctttttggcaagagctaaatttatttctcttattactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaacaggatgaagacttgtggatatggatggtggtgatggttgcacaacaatatcaatttattttataccactgaaccgtgcacttcaa

SEQ ID NO: 74 - DNA, 537 bp, Homo sapiens
gccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccact

SEQ ID NO: 75 - DNA, 437 bp, Homo sapiens
agctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaactcatctttctccctaattcatcccaggacaa

SEQ ID NO: 76 - DNA, 99 bp, Homo sapiens
gggccagtgctgggaggattttgtgggccaggagctgtaccggttcctggtgatggacttcgtcctcatgttgctggacacgctttttggggaactggt

SEQ ID NO: 77 - DNA, 109 bp, Homo sapiens
gcaatttaacgagccacttccatgatctccaaagaaaccaaaatacaaacacaatatttaatcttgccaaccgaagacgatgtgactgcatgaagtgcccttcgtttta

SEQ ID NO: 78 - DNA, 502 bp, Homo sapiens
tgtccatacagagtgtgcattccctggcaggggctcctgctcacagcctcgcttttaaccttctggaacctgccaaacagtgcccagaccaatattgatggtgtgccgttcaatgtcgcagaagggaaggaggtccttctagtagtccataatgagtcccagaatctttatggctacaactggtacaaagggcaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggaatctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatagc

SEQ ID NO: 79 - DNA, 557 bp, Homo sapiens
gtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgata

SEQ ID NO: 80 - DNA, 502 bp, Homo sapiens
gcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcact

SEQ ID NO: 81 - DNA, 418 bp, Homo sapiens
  misc_feature (168)..(168): n is a, c, g, or t
  misc_feature (336)..(336): n is a, c, g, or t
  misc_feature (352)..(352): n is a, c, g, or t
tggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatngtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcnaaattgaggacaatgnttagttataagtctccgagttggaaaaggaagaaagccagagctgtctagtttcattcattctttc

SEQ ID NO: 82 - DNA, 510 bp, Homo sapiens
  misc_feature (107)..(168): n is a, c, g, or t
  misc_feature (240)..(240): n is a, c, g, or t
  misc_feature (242)..(245): n is a, c, g, or t
  misc_feature (247)..(274): n is a, c, g, or t
  misc_feature (276)..(279): n is a, c, g, or t
  misc_feature (281)..(292): n is a, c, g, or t
  misc_feature (294)..(295): n is a, c, g, or t
  misc_feature (300)..(300): n is a, c, g, or t
  misc_feature (329)..(329): n is a, c, g, or t
  misc_feature (333)..(333): n is a, c, g, or t
  misc_feature (338)..(354): n is a, c, g, or t
  misc_feature (359)..(359): n is a, c, g, or t
  misc_feature (362)..(386): n is a, c, g, or t
  misc_feature (393)..(393): n is a, c, g, or t
  misc_feature (399)..(399): n is a, c, g, or t
  misc_feature (404)..(420): n is a, c, g, or t
  misc_feature (445)..(445): n is a, c, g, or t
  misc_feature (470)..(470): n is a, c, g, or t
  misc_feature (483)..(483): n is a, c, g, or t
aggcttaccatgcagggctgaaggcctctgaaagaacgctggtgcagaacgactggatggaggagaaggtccctgtaattgttgcaaccattagttttgggatgggnnnnnnnnnnnnnnnnnnnnnnnnnnnnnnnnnnnnnnnnnnnnnnnnnnnnnnnnnnnnnnactaccaggagtctggccgggctggcagggatgggaagccttcctggtgccgtctctattactccaggaatnannnngnnnnnnnnnnnnnnnnnnnnnnnnnnnnannnncnnnnnnnnnnnnannaaaanagaggaaacaaagcatctgataaagccantatnatggnnnnnnnnnnnnnnnnnacctnctnnnnnnnnnnnnnnnnnnnnnnnnngccacgnaagagnctaannnnnnnnnnnnnnnnngttgtgtccagcatcggactgtganttcctcaagagagcacccaggaganttttacatttggntaaaagccttggatcactcactcatgg

SEQ ID NO: 83 - DNA, 426 bp, Homo sapiens
  misc_feature (59)..(59): n is a, c, g, or t
  misc_feature (233)..(236): n is a, c, g, or t
  misc_feature (261)..(261): n is a, c, g, or t
  misc_feature (292)..(292): n is a, c, g, or t
  misc_feature (305)..(305): n is a, c, g, or t
  misc_feature (325)..(325): n is a, c, g, or t
  misc_feature (371)..(371): n is a, c, g, or t
  misc_feature (379)..(380): n is a, c, g, or t
  misc_feature (401)..(401): n is a, c, g, or t
gtggaaccgatacttccggaacaaggctatctgagagcagttcttcctggccctcgggnttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcagagagcaccaccannnnagacctccggctgaggtcagcttcncagagaggaaggtaagggaccgtccctagcntcaggactggcancccaccctgcagagagccangccttcctcaggagggctctgctggacagagacctgatcaagggcntctcccanntccttcaggatggagacaaanaacccaactggtgaccaagagtggt

SEQ ID NO: 84 - DNA, 496 bp, Homo sapiens
gaagccagtatgagggccagggccagtgctagggccggcatccacctctggtgagggttggtgaaaagttggccagtgggtccccgtgaggacgaactacttgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatt

SEQ ID NO: 85 - DNA, 434 bp, Homo sapiens
  misc_feature (26)..(26): n is a, c, g, or t
  misc_feature (66)..(66): n is a, c, g, or t
tcggtctccgggaacacgtaggtgcngaaggtgctgtaaggcagcttcaggatgtcgttggctcgncactatgtggaagcgcggctggtacttgtgcatggagtttaggatggtgaagccgtgcttgtcagagatgttgttggtcagcttcagcttgtggaaggccacaggcttagccatccactgctcccccgtggctgggctgtctgggtggatgtacatgcgtttgggcatctcagggtcggccttgcccgccaccatccagcgcgagttgtggaacttatagcggcaatcgtcagcggctacaatgtccatcagcaggatatacttggccttcttgtccaggccgctgactcgcaccttgaagggggggaacatccgcctcccggacttggtgatgaccatctccgtgcctagcttgtggaactggtccc

SEQ ID NO: 86 - DNA, 345 bp, Homo sapiens
  misc_feature (71)..(71): n is a, c, g, or t
taatcatacccaaagtcagcatctggatgaagaagtgtatcgaaaagtactgcaactggattggatgatcngccctcaaggccctcagacaagtattctaagtcctgatcaacaatggaaagatgtcttgcttcttctaatttactatttaagattgtatttgggtgtattgcttctgatgataaatacggtctgtagcctgataacatataagaaaggcatattcctgagggtccatttcctattattaccacaggaaaagtcactgacgaatcttccagtaaagaagtttcttcaactaatggcatcgctttaacttttcgccccaagttgtcaccaaagtat

SEQ ID NO: 87 - DNA, 397 bp, Homo sapiens
  misc_feature (116)..(116): n is a, c, g, or t
  misc_feature (249)..(249): n is a, c, g, or t
  misc_feature (290)..(290): n is a, c, g, or t
  misc_feature (364)..(364): n is a, c, g, or t
  misc_feature (372)..(372): n is a, c, g, or t
aaaatgctggggtgctgaaatctcaagggccccattacaaaactccttaggaacctcgccctctctctgctgtaaggactggttccagaatgagagaatttaaaagacattccccncccaaaatgttcataatgtcaccccggaaacctgcgaatatgttatattacatgaccagggagaagtaaggttgcagatggcagtaaggttgctaatgggctgaccttaagataaggagatgatcctggattntctgggtggacccaatgtaatcacaagggtccttaactgtnggaatagtgaggtggctgagtcagaggcagagtgatgcaatgactgaaagacttaaccagccatcaccggcttntgaatacnggaagacggtcatgagccagggaat

SEQ ID NO: 88 - DNA, 378 bp, Homo sapiens
  misc_feature (27)..(27): n is a, c, g, or t
  misc_feature (182)..(182): n is a, c, g, or t
  misc_feature (231)..(231): n is a, c, g, or t
  misc_feature (288)..(288): n is a, c, g, or t
  misc_feature (316)..(316): n is a, c, g, or t
  misc_feature (346)..(346): n is a, c, g, or t
gtgggtaaccatgaaagcacacctgtnaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaganttggggggttctatgctctttccccataccccggtctccgcctcatctntctcaatatgaatttttgttcccgtgagaacttctggctcttgatcaactccacggntcccgcaggacagctccagtggctggtnggggagcttcaggctgctgaggatcgaggnagacaaagtgcatataattggccacattcccc

SEQ ID NO: 89 - DNA, 556 bp, Homo sapiens
gcagccaccagcgaatgctaggtctcggactaagcctacctgctctccaagtctcagtggcttcatctgtcaagtgggactctgtcacaccagccattcttatctctctgtgctgtggaagcaacaggaatcaagagactgccctccttgtccacccacctatgtgccaactgttgtaactaggctcagagatgtgcacccatgggctctgacagaaagcagatcctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaattccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgt

SEQ ID NO: 90 - DNA, 549 bp, Homo sapiens
catctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttgg

SEQ ID NO: 91 - DNA, 432 bp, Homo sapiens
  misc_feature (100)..(100): n is a, c, g, or t
  misc_feature (399)..(399): n is a, c, g, or t
ggttctcggctcagtgaactttctaaagtgcagatttctgagctttcatttcctgcctgtaacacggttcatcccgagttactccctgagtcttcaggcnacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcanctgtcagtggtattcccatgttacaacagcact

SEQ ID NO: 92 - DNA, 422 bp, Homo sapiens
  misc_feature (348)..(348): n is a, c, g, or t
ccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaantcctgccctaccatcaatacctgccactctgtacatcacaaagttgaaatgcatgttggtttctcatatttcat

SEQ ID NO: 93 - DNA, 439 bp, Homo sapiens
  misc_feature (29)..(29): n is a, c, g, or t
gtgcagagatgaggtccttctggactaanaagccaaaaaagagaaagaaaaaaataatttattcttttctgttgtattgtgcgtaagttaagaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagctgacggccagtaaagtggacttaactcccaaggtgtgtcgcgccggacaccgggccctggacatgctgcttccatgtgcagtcccttccctgcttctcgctgtctgtccttgttcccacctcccagccccgcaggttgcagagttgttgtctgcagtccagtgtgggtagagcgatcggtgtacggggttcc

SEQ ID NO: 94 - DNA, 257 bp, Homo sapiens
cattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatgg

SEQ ID NO: 95 - DNA, 494 bp, Homo sapiens
  misc_feature (41)..(41): n is a, c, g, or t
aaaggaagctgaccgcacagtgtccagacgaattggccccnagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtt

SEQ ID NO: 96 - DNA, 459 bp, Homo sapiens
gagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacggg

SEQ ID NO: 97 - DNA, 383 bp, Homo sapiens
agcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggaga

SEQ ID NO: 98 - DNA, 462 bp, Homo sapiens
aggtggaagctatgctggttccctggctgagccctacgaggagctggaggccgaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccaggatttgcacccacgcaccagccacaccactgtgcgcccgcacgaccccgggcctgagccctggcacccgatggccacccacccgcgcccgccactcggggcccctgccccgcatcctgcagcccgcttagtctgatgacgaggaagcccgccagaaagtccagaagaaggaacgacggacgcaaagcggcgcc

SEQ ID NO: 99 - DNA, 501 bp, Homo sapiens
atcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccactgcctcctccctgctctcctgtgcaggaatgtctctgagctgttcacgttgatgcttcttggttggcaagacttgggtgtagacatgaaaccatcttactaaaagtgtcttaaaatgaccaattccagaatcaagcgtattccgttttcttcctgcatgatccctgggccctcccgcaggctgagcaagtctgtaaactgattctgggagaaaccaagctgctggccatagggtgtccttgggtacatccaggagtcttcattgcttctgttattacc

SEQ ID NO: 100 - DNA, 378 bp, Homo sapiens
cctctagccctgggacactgtaattcacctttggctttcccactgggggcccgagtggagttagaagcatggagaggcagcccaggggatccttagtggcagatgcttaaacctttgagccttccctgaaatactgctcagggtcaaaaccgggatccccgttttacagatgaggaagctgaggcaggggctggaattcacatgggctctgcttttctctctctgctgtggaacttcctcctagagctcagccgtcctcccttttgggggaaatggcatctttggcatggcttggtggctcccgcctggaatcccaacattttgggaggccgaggtgggaggatcgcatgagcccagcagttcaagacaggtccgggc

SEQ ID NO: 101 - DNA, 505 bp, Homo sapiens
caaggtgaaacactgcagtcccggtgtggtggctccccatgcaggacgggccaggctgggagtgccgccttcctgtgccaaattcagtggggactcagtgcccaggccctggcacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggcgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatag

SEQ ID NO: 102 - DNA, 514 bp, Homo sapiens
  misc_feature (101)..(101): n is a, c, g, or t
  misc_feature (108)..(108): n is a, c, g, or t
ggtgccagagttagccgggactgaagccgtcgtcttcttaagacggagttccataatgggccgggagtacaccccctggtacgtagcgaggtatctgcggncaggggncgaggcgtccaggcccgttttgttcgtgaccgggcccatggccaagctgccaggcatgggggaaccgtagccggggtagtgcatcacctgttcgtaggccttgaggtccattttgtggggctggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccggcgtccccttcagctctcccaggccccctcgcttgtgctcctggcacggggaggcgctcgagtgaggcgactcg

SEQ ID NO: 103 - DNA, 494 bp, Homo sapiens
taggtggtgccccagtagggactgtgtgtggggtctctgaccccacatttcccttctgcactgccctggcagaggatctccatgagggccctgcccctgcagcaaacttctgcctggccatccaggcatttccgcacatcctctttaatctaggcgaaggtttccaaaccccagttcttgacttctgtgcactcgcagtctcaacaccacatggaagctgtcaaggcttggagcttgcactccccgaagctacagcccaagctctaccttgcctcctgtcagtcatggttgggagtggctgggatgcagggcaccaagtccctaggctgcacacagcatgaggaccccgggcctggccaacaaaaccattttttcctgatatctctggacctgtgatgggaggggttgccataaagacctctgacatgccctggagacattttccccattgtcttgggaattagcatttggctcctgttactcatgcaaatttc

SEQ ID NO: 104 - DNA, 448 bp, Homo sapiens
ttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacaggggttagtggggctttctatggagccatctgctttggggacctagacctcaggtggtctcttggtgttagtgatgctgg

SEQ ID NO: 105 - DNA, 534 bp, Homo sapiens
tccgtgccagccctttgaaggagatggccacatctgtaggccttgtgcagaacccaggcaggagtgtccacatctgccactggagtgtgtcgtagatcttagattccactgtgctgcctgcctgagccaggtccatggctttgctcttcagggtgttagccaggggcaagaagtaggtggtgaaaaaaccaagtcgcgtttcctgaacatggtctcggatgacaggcagcagccagctccgtgggaaatccagagtctcctcagagccatcaatttccaaaggcacagcctgcagcaccacctcaggtcccatactggtcaccgcagcccccactgcctggtcaagagccgccgtgtgggggaaatgaggggagaggcgcaggtcacacagggactggaggcacttcctcatcacagggtgggcctgtctcccacacgcctcgaagaagacacacagcagctgcaacacggagctccaggccgcatggaatttgtacgtcaggccctcctccactgccctgaacatcttggcaa

SEQ ID NO: 106 - DNA, 466 bp, Homo sapiens
ttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctcctta

SEQ ID NO: 107 - DNA, 482 bp, Homo sapiens
agcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggg

SEQ ID NO: 108 - DNA, 505 bp, Homo sapiens
cgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaa

SEQ ID NO: 109 - DNA, 484 bp, Homo sapiens
accaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaa

SEQ ID NO: 110 - DNA, 453 bp, Homo sapiens
tcctgtgatactcgagaaagcctgtgagttcatagagcttctttttggcctttccctgatagaagtgggccctgaccatttctatgtgtttgcaaacacagtagacctcgccgatgagggtagtgatgacacgggcaggcctgagaactgcctcctgattcttattctgagtgtgatcttcataacgggcagctgtgcccctgaggaggtcatctgggaagtgctgaaggcaataggggtgtatgctgggagggagcacttcgtctatggggagcccagggagctcctcactaaagtttgggtgcaggaacattacctggagtattgggaggtgcccaacagttctcctccacgttatgaattcctgtggggtccaagagcccattcagaaagcaccaagcagaaagtactagagtttttggccaagctatacaatagtatccctatttcctt

SEQ ID NO: 111 - DNA, 255 bp, Homo sapiens
ttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagatgtgtcctatgaaggggtgtggggtgaggtagtgaaaagggcggtagttggtggtggaacccagaaacggacgccggtgcttggaggggttcttaaattat

SEQ ID NO: 112 - DNA, 285 bp, Homo sapiens
  misc_feature (28)..(28): n is a, c, g, or t
  misc_feature (30)..(30): n is a, c, g, or t
  misc_feature (54)..(54): n is a, c, g, or t
  misc_feature (70)..(70): n is a, c, g, or t
  misc_feature (81)..(81): n is a, c, g, or t
  misc_feature (100)..(100): n is a, c, g, or t
  misc_feature (107)..(107): n is a, c, g, or t
cccgtccctgaagttacatgttcagtananacacaaaaacaccgccaatgccanctcaaaagcacctgcntggggagcgtnggggtgaagagctgtgggngtcggangggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgg

SEQ ID NO: 113 - DNA, 538 bp, Homo sapiens
gttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaa

SEQ ID NO: 114 - DNA, 546 bp, Homo sapiens
tagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgctta

SEQ ID NO: 115 - DNA, 464 bp, Homo sapiens
  misc_feature (84)..(86): n is a, c, g, or t
  misc_feature (88)..(93): n is a, c, g, or t
  misc_feature (97)..(98): n is a, c, g, or t
  misc_feature (100)..(100): n is a, c, g, or t
  misc_feature (102)..(104): n is a, c, g, or t
  misc_feature (107)..(110): n is a, c, g, or t
  misc_feature (112)..(112): n is a, c, g, or t
  misc_feature (114)..(116): n is a, c, g, or t
  misc_feature (118)..(118): n is a, c, g, or t
  misc_feature (120)..(121): n is a, c, g, or t
  misc_feature (182)..(183): n is a, c, g, or t
  misc_feature (310)..(311): n is a, c, g, or t
  misc_feature (352)..(352): n is a, c, g, or t
gaaggcttaatctctttcagctctgaaacatcacacatctaagattcaagagtttgccgacctaactcgggttgaaacttttgnnntnnnnnngaanncncnnngcnnnntntnnncncnnagtgatgtcaccatttctacctgccacgtatcggcgaaggttgggactcgactggtgtttnngatcacgatgggaaaatcatccagaaaaccccctacccccaccccagagggaccacagtcagcgtgaagcagttattttctacgctacctgtgcgccataaggaatttcaaaggaatattaagaagnnacgtgcctgcttccccttcgccttctgccgtgattgtcagnttcttgagggctccccagccatgcttcctgtacagcctgcaaaactccaagaagagcccaagaagacattactactaactgtcacatggtgtcacggatgggatcttcggac

SEQ ID NO: 116 - DNA, 517 bp, Homo sapiens
ctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaat

SEQ ID NO: 117 - DNA, 519 bp, Homo sapiens
caaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaagcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttc

SEQ ID NO: 118 - DNA, 434 bp, Homo sapiens
gaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttccc

SEQ ID NO: 119 - DNA, 525 bp, Homo sapiens
  misc_feature (319)..(319): n is a, c, g, or t
tagggactccaaaggcagctgacagcatctggctttcagttcctcagtcaccactactttgtaccaaattcactgttttggctctgaaatctaattttgagtttagcaaggatgtctgcattgctcatgcaaatgaactaagcgttcattggaatgacaccatcaccacccaaatgaaaagaactggctggaatattcatcagcctactaatgtcatctcccaacccactctccaaactccatcccaaaaaagcatccagttcagaattgcccactgttggcaaagaaagaatgtcactaatttatttacagggagcanatagcagggacttacagatgaaccaggccctgcgatttttggaaaatgagcaccaggaactgcaggccaagattgaatgcctgcaaggggacagagacctgtgcatcttggatacccaggacctacaagatcaactaaaaaggtcagaggctgagaaacctaccctggtgaccaaataacagaattggcaggttttgcttcaaaat

SEQ ID NO: 120 - DNA, 545 bp, Homo sapiens
  misc_feature (42)..(42): n is a, c, g, or t
  misc_feature (66)..(66): n is a, c, g, or t
  misc_feature (106)..(106): n is a, c, g, or t
  misc_feature (133)..(133): n is a, c, g, or t
  misc_feature (137)..(137): n is a, c, g, or t
  misc_feature (236)..(238): n is a, c, g, or t
  misc_feature (357)..(357): n is a, c, g, or t
gatggggattctagaagcagttcggttatacctgggcaccangggcaacctgacagaggctgaganggccgctggccgccagcctggccctcacggctggcaccgncctcctctctgcccacttcctgctttngcangccctagtgttgtgggcggactgggccctcagcgccacgctcctggcccttcacggcctggaggccgtcctgcaggtggttgccatcgcggccttcacnnncaggggcttcggaggagaggtcagggctaaggccggggatgagactgcaggagagagagcagcggagggccacattcggagcctccgtccactccagttttatcagcttttgccttttncacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaa

SEQ ID NO: 121 - DNA, 495 bp, Homo sapiens
agactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaa

SEQ ID NO: 122 - DNA, 377 bp, Homo sapiens
tttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatcta

SEQ ID NO: 123 - DNA, 496 bp, Homo sapiens
agcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcgacaaagtagctgaacgtgtcttaatgagactacaagagaaactgaaaggagtggaagaaggcactgtgctcagtgttggtggacaggtgaatttgctcatacagcaggccatagaccccaaaaatct

SEQ ID NO: 124 - DNA, 555 bp, Homo sapiens
atagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctt

SEQ ID NO: 125 - DNA, 423 bp, Homo sapiens
tctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttaccccacaagggggccgctgcgagaagttcacccacccccgaaaaaataattaaactcgcaggccaggcacg

SEQ ID NO: 126 - DNA, 551 bp, Homo sapiens
cctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgagga

SEQ ID NO: 127 - DNA, 544 bp, Homo sapiens
  misc_feature (425)..(425): n is a, c, g, or t
gatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccanagtggccataccaaagaggctaccgattccttcctgctacctggatccctgaagttgccctggtctctgcaccttctaaacctagttcttaagagctttccattacatgagctgtctca

SEQ ID NO: 128 - DNA, 538 bp, Homo sapiens
gtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgagtatgaccagtcgtactatcttactgagccacagtgatgcatgcttttcggggaaaacttcattcacaagtattccagacaccaggcttcaggcatggccatgagcaagaccagcaaataacagctttttcccttgcagccctgaccccaatgtctgctgtttccaacactggtgatttctaactacggcccacagcagatgctgttgaataacaccatggcttcatcagaggatgtggggttgtagtacctctggg

SEQ ID NO: 129 - DNA, 94 bp, Homo sapiens
ttaattgcacatcagtatgtgccaaatctactagacattggagaaacagtaggaacaacacatggtaccggcacatggatctttcaggaaaacg

SEQ ID NO: 130 - DNA, 563 bp, Homo sapiens
agagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactc

SEQ ID NO: 131 - DNA, 353 bp, Homo sapiens
tcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggca

SEQ ID NO: 132 - DNA, 208 bp, Homo sapiens
caggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgcca

SEQ ID NO: 133 - DNA, 509 bp, Homo sapiens
gcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggcttctaatga

SEQ ID NO: 134 - DNA, 386 bp, Homo sapiens
ccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgcccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgaggggggccgacccccatctccaccccgcgggctctccaggagcctcagcccaccgccagtactctcccagcaaccgcgagcaatttcttgggaccaaagt

SEQ ID NO: 135 - DNA, 524 bp, Homo sapiens
cctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcggtagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctaca

SEQ ID NO: 136 - DNA, 418 bp, Homo sapiens
gcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtc

SEQ ID NO: 137 - DNA, 543 bp, Homo sapiens
gggactaaggacagccatgaccccctgccatcctgggcagagctgttgaggcccaagtaccgggcaccccagggctgctcaggtgtggacgagtgtccccggcaggagggcttgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgattccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggccttg

SEQ ID NO: 138 - DNA, 456 bp, Homo sapiens
tctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgcccc

SEQ ID NO: 139 - DNA, 465 bp, Homo sapiens
atcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctagg

SEQ ID NO: 140 - DNA, 506 bp, Homo sapiens
gtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatt

SEQ ID NO: 141 - DNA, 426 bp, Homo sapiens
cacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgta

SEQ ID NO: 142 - DNA, 556 bp, Homo sapiens
  misc_feature (99)..(99): n is a, c, g, or t
  misc_feature (110)..(110): n is a, c, g, or t
  misc_feature (392)..(393): n is a, c, g, or t
  misc_feature (410)..(410): n is a, c, g, or t
  misc_feature (437)..(437): n is a, c, g, or t
  misc_feature (448)..(448): n is a, c, g, or t
  misc_feature (452)..(452): n is a, c, g, or t
  misc_feature (472)..(472): n is a, c, g, or t
  misc_feature (491)..(491): n is a, c, g, or t
cagaacactcatgtctacagctggcccaagaataaaaaaaacatcctgctgcggctgctgagagaggaagagtatgtggctcctccacgggggcctctngcccacccttncaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttccnnctgacagtttgatgtgnccattctgggcctctcagtgcttagcnagtagataatngtangggatgtggcagcaaatggnaatgactacaaacactctnctatcaatcacttcaggctacttttatgagttagccagatgcttgtgtatcctcagaccaaactg

SEQ ID NO: 143 - DNA, 478 bp, Homo sapiens
  misc_feature (32)..(33): n is a, c, g, or t
  misc_feature (39)..(39): n is a, c, g, or t
  misc_feature (128)..(128): n is a, c, g, or t
  misc_feature (230)..(230): n is a, c, g, or t
  misc_feature (233)..(233): n is a, c, g, or t
  misc_feature (240)..(241): n is a, c, g, or t
  misc_feature (249)..(249): n is a, c, g, or t
  misc_feature (275)..(275): n is a, c, g, or t
  misc_feature (296)..(296): n is a, c, g, or t
  misc_feature (307)..(307): n is a, c, g, or t
agtgggaagctctcaagtctgttgagactagnncactancttgcattaaaagtctgtatggctaacatttccaatgatcactggccatctttggttcaagaggctacaactgaggccttgaagctttngcttttgtccactggctgttcttttacaagctttgttacaattcaaacgcaaaatgggggcaagagagacacggcgtcttttggaaagagtggtatatcagnccngggtatnncccaaatnctattgcatcaactgcacgttggtancctactgagacacttatatgnccaaagatganctatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaa

SEQ ID NO: 144 - DNA, 453 bp, Homo sapiens
aatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggctacagcaaacatcattcaagatgtccagcaaagggagcagcacagatggcagaacagacttagctaatggaagcctgtttagcagtccagaggagatgtttggagctgaaaaggggagggagacatcctcaggcattgaagtggaggcctcagacctgagtttgagcttgactggggatgatggtggccccttttcccagcagctctgagaccagatgttggctgctgtacttactccttgaggtagggaatgtgtggtgatcgagtggtctgtgttcctattgctggtggggtgat

SEQ ID NO: 145 - DNA, 494 bp, Homo sapiens
aactacaactactaccacataaacatgatatcatcacacttcttggtgttggaggccactgggtaacaacagaagaaaaccttcagttggatcctccagatagccactgccttttgctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacattt

SEQ ID NO: 146 - DNA, 444 bp, Homo sapiens
caacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgcct

SEQ ID NO: 147 - DNA, 317 bp, Homo sapiens
  misc_feature (87)..(87): n is a, c, g, or t
ggccccggatgcatgtgacaacatcctggctcggaatgtgacatggcaggagtgctgctgtactgtgggtgagggctggggcagcgnctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagt

SEQ ID NO: 148 - DNA, 492 bp, Homo sapiens
  misc_feature (68)..(68): n is a, c, g, or t
ttctagaagctctcaatcactttgagaaagcaagaaccttgatttatcgtcttcctggagtgttaacnttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacag

SEQ ID NO: 149 - DNA, 385 bp, Homo sapiens
taatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcgcctggaggagaagtcatctcatgacaacagaagggaggtggccgggctgagcacggagacccaccgtgcaggggcctttcatgggaacggcccacacgcagtttgaccccacgcccagcccttctggcacccctggggttcaata

SEQ ID NO: 150 - DNA, 336 bp, Homo sapiens
  misc_feature (299)..(299): n is a, c, g, or t
gtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcngtttctgtcccacttaactgacctcactggaggctac

SEQ ID NO: 151 - DNA, 369 bp, Homo sapiens
gcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaa

SEQ ID NO: 152 - DNA, 468 bp, Homo sapiens
  misc_feature (48)..(48): n is a, c, g, or t
  misc_feature (85)..(85): n is a, c, g, or t
  misc_feature (98)..(98): n is a, c, g, or t
  misc_feature (119)..(119): n is a, c, g, or t
  misc_feature (291)..(291): n is a, c, g, or t
  misc_feature (331)..(331): n is a, c, g, or t
ttccaggcttgattgcaggctcaggaaagtttgagaaaagcatctgcnaaaaaaataaagagcagagcttacctcattgcctgtncccaccccatccnaggtcaccacctggctgaccncaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctntacgtgctgcccattcccctgtgagcaccctcctctcggnctctggccaacgcagtcccacccatctgtgggtaacaagggggtgtcggtgttctttgcagccttgctaaactgtctgaatcaaggatcacaaactacagcctgcaggccaaatccagcccacagcctgtgtttgta

SEQ ID NO: 153 - DNA, 538 bp, Homo sapiens
ggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccctgcctccacttggggaccctgcctcgtgtcgtctttatctgcctattactcagcctaaggaaacaagtacactccacacatgcataaagg

SEQ ID NO: 154 - DNA, 547 bp, Homo sapiens
ccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatat

SEQ ID NO: 155 - DNA, 467 bp, Homo sapiens
cctgcacgctctgcggggagaaaaggaggggcctgcctggctagccctgaacctttcactttccatttctgcgccttttctctcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggcgactgctgttgccaatacctcagactccagggaaagagaggaggccatcattctcactgtaccactaggcgcagttggatataggtgggaag

SEQ ID NO: 156 - DNA, 547 bp, Homo sapiens
taatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcga

SEQ ID NO: 157 - DNA, 398 bp, Homo sapiens
gcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactgg

SEQ ID NO: 158 - DNA, 524 bp, Homo sapiens
  misc_feature (152)..(152): n is a, c, g, or t
  misc_feature (192)..(192): n is a, c, g, or t
  misc_feature (216)..(216): n is a, c, g, or t
  misc_feature (261)..(261): n is a, c, g, or t
  misc_feature (280)..(280): n is a, c, g, or t
  misc_feature (294)..(294): n is a, c, g, or t
  misc_feature (323)..(324): n is a, c, g, or t
aaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttttngctgaaatacattatattgtacgtttgagataattctagntacaaagtataataaaactagatngtataataaaccctttaaatcattggtaagtgtacaagtggtggnaactgaagcatttactggnacaaagtaatgttnactctaatggttacttgctcgtgcgttgnnccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacct

SEQ ID NO: 159 - DNA, 469 bp, Homo sapiens
tactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggg

SEQ ID NO: 160 - DNA, 477 bp, Homo sapiens
gtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactgggaaacttagagtcatgagtttatgaggctggatttgggcacctttcctttgcctttggttcactgtgagttctgatgtcctagtgacttaggtcttagaagctcacgccttagtttgaaacagattctccacggtggtccccaaaacactgtctgcatatccataagaattgaacgctatgggtgttaacgtgcatgaggatcagtttgcagcagcaagtaca

SEQ ID NO: 161 - DNA, 549 bp, Homo sapiens
ctttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctatttt

SEQ ID NO: 162 - DNA, 509 bp, Homo sapiens
gtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggat

SEQ ID NO: 163 - DNA, 463 bp, Homo sapiens
ttgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcacta

SEQ ID NO: 164 - DNA, 444 bp, Homo sapiens
ctggaccctatcgtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtctcggcgaaggttgggactcgactggtgtttgatcacgatgggaaaatcatccagaagaccccctacccccaccccagagggaccacagtcagcgtgaagcagttattttctacgctacctgtgcgccataaggaatttcaaaggaatattaagaagaaacatgctgcttccccttc

SEQ ID NO: 165 - DNA, 377 bp, Homo sapiens
  misc_feature (36)..(36): n is a, c, g, or t
  misc_feature (47)..(48): n is a, c, g, or t
  misc_feature (55)..(55): n is a, c, g, or t
  misc_feature (108)..(108): n is a, c, g, or t
  misc_feature (144)..(144): n is a, c, g, or t
  misc_feature (234)..(234): n is a, c, g, or t
  misc_feature (274)..(274): n is a, c, g, or t
  misc_feature (295)..(295): n is a, c, g, or t
aaccacctgctgcacgagagcgacacggacaaggangggcggctgannaaagcgnaaatcctgggtaattggaacatgtttgtgggcagtcaggccaccaactatggngaggacctgacccggcaccacgatgagctgtgagcnccgcgcacctgccacagcctcagaggcccgcacaatgaccggaggaggggccgctgtggtctggccccctccctgtccaggccccgcagnaggcagatgcagtcccaggcatcctcctgcccctgggctntcagggaccccctgggtcggncttctgtccctgtcacacccccaaccccagggaggggctgtcatagtcccagaggataagcaatacctatttctgactgagt

SEQ ID NO: 166 - DNA, 463 bp, Homo sapiens
tactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagcta

SEQ ID NO: 167 - DNA, 393 bp, Homo sapiens
cccacagtcagtatctctgcgggaacagagtagccgtgtgtggcggtgcagggccccgcagtctaggcatggttggcagtagaagggtgaactgctgacacattggctgacctggcactccacaaaccagcctggcttacagccacagcgggtgtcggccactgctgaacagttctccagcgccacctgggaggcctgctcatcacaggcctggcagcgggcacattcagaattatggtggttctcccaggccaagaaggtgtcttggggacacacaaggcaggtggagttgccgcagggctccgtgcaaggggccttcaggtagtgccccgctgggcagcctctgcaacaaaacagaccaatcttcttgtggaagtcaccggcacagtcaca

SEQ ID NO: 168 - DNA, 514 bp, Homo sapiens
tccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatcttatcattcgtcttcttttccaaactacacatcactg

SEQ ID NO: 169 - DNA, 424 bp, Homo sapiens
agagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaag

SEQ ID NO: 170 - DNA, 472 bp, Homo sapiens
cttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtct

SEQ ID NO: 171 - DNA, 165 bp, Homo sapiens
cagccacgtgcagcctatcaagctggccagggtcaccgaggtcctgggcaggaccggctctcagggacactgcacgcaggtgcgcgtggaatttatggacaacacgagccgctccagcatccgcagtgtaaaaggccccgtgtgtgagggggacgtgctcaccct

SEQ ID NO: 172 - DNA, 358 bp, Homo sapiens
aaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttgga

SEQ ID NO: 173 - DNA, 441 bp, Homo sapiens
gcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtatt

SEQ ID NO: 174 - DNA, 524 bp, Homo sapiens
accacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcc

SEQ ID NO: 175 - DNA, 149 bp, Homo sapiens
tcatgaaccaggaaaaactcgccaaactgcaggcaaaagtgcccattggtggaactgctcacagaaagaaggtggttcacagaacagccacagcaaatgataaaaaacgtcagttctccttaaagaagttagaaatctctggcattgaa

SEQ ID NO: 176 - DNA, 462 bp, Homo sapiens
agcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatg

SEQ ID NO: 177 - DNA, 514 bp, Homo sapiens
  misc_feature (202)..(202): n is a, c, g, or t
  misc_feature (214)..(214): n is a, c, g, or t
  misc_feature (227)..(227): n is a, c, g, or t
  misc_feature (234)..(235): n is a, c, g, or t
  misc_feature (244)..(244): n is a, c, g, or t
  misc_feature (276)..(276): n is a, c, g, or t
  misc_feature (283)..(283): n is a, c, g, or t
  misc_feature (350)..(350): n is a, c, g, or t
  misc_feature (354)..(354): n is a, c, g, or t
  misc_feature (360)..(360): n is a, c, g, or t
  misc_feature (392)..(392): n is a, c, g, or t
  misc_feature (459)..(459): n is a, c, g, or t
  misc_feature (461)..(461): n is a, c, g, or t
  misc_feature (463)..(465): n is a, c, g, or t
  misc_feature (468)..(468): n is a, c, g, or t
gaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatncagaaaaccccntacccccaccccngagggannacagtcagngtgaagcagttattttctacgctacctgtgcnccataangaatttcaaaggaatattaagaagaaacgtgcctgcttccccttcgccttctgccgtgattgtcagnttcntgaggnctccccagccatgcttcctgtacagcctgcanaactgactcctagaagtaccccaccccacccctgctccttggaggacaacgtgatcactgtattcancncnnncangaatggtccaggttcttctagatgatctgcacaaatggctcctctc

SEQ ID NO: 178 - DNA, 503 bp, Homo sapiens
gttgcctgcccggagatcgggaactctgccccgtaggactggaagaaacctcagtaatgggaataagactttgtccaatagggggctgatgaatgtgtgggggcgacaatggcaaggagtgggactcccggcccggggttcgccaaccccaggggccacaggtcctcctacaattgaaccagaattcacccacccgggcctgccctgtgcagggtgccgagagcccagggatgcatgagagggtggctcctgcctctgggaactgggacagtgggagagacggataagttgtcacacagaggctgctgggaggaaggaggagacagaaggagtaggggatgggacttcattcgttcatcaaatgcacacgaggcacaaatgggaatcaagggtggatgtgctgtgatgaagagaagtcctgccctgaacaaggtggcgctgtggaggaggcagagatcagatttgtctgcggaggtgttatggactgaactgtgtccctgccc

SEQ ID NO: 179 - DNA, 436 bp, Homo sapiens
gagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatcta

SEQ ID NO: 180 - DNA, 461 bp, Homo sapiens
tatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccat

SEQ ID NO: 181 - DNA, 321 bp, Homo sapiens
gatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctgg

SEQ ID NO: 182 - DNA, 282 bp, Homo sapiens
gaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgc

SEQ ID NO: 183 - DNA, 510 bp, Homo sapiens
ggagattctggacgcaaagacaagggagaagctgtgtttcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactgcacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcagctcacccctgctgaggctcagcccctcaacccggtggcattctggggga

SEQ ID NO: 184 - DNA, 292 bp, Homo sapiens
  misc_feature (136)..(136): n is a, c, g, or t
  misc_feature (265)..(265): n is a, c, g, or t
ttaacccatggttgagacgttccaagttagatctgctgctcttaggtgtggggctgtccacattagggaacttgcctcaaaaacagtccacagtggcaataccggacttctgttcaagctttttaaagtgctgagncttacaaacccctgaaggaaggtgaccctttaagagaggatcatctttttttatatttattttcaccaaatagggtgatgagggttggtttttgttccctcaacccatttgggtaaaataacggatctnattagaaactgttttaaggaggggctg

SEQ ID NO: 185 - DNA, 541 bp, Homo sapiens
tcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggt

SEQ ID NO: 186 - DNA, 468 bp, Homo sapiens
accaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttc

SEQ ID NO: 187 - DNA, 390 bp, Homo sapiens
atttctatttggggtcctcacggagaagaacaccaggaaagacagacaggaccagtgccatgggccagctttgctgctttcctttctcaagagatgaaggaaaaatcagtgagttggaaagctcgtcctctgcagtcctacaaagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcc

SEQ ID NO: 188 - DNA, 213 bp, Homo sapiens
gaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagc

SEQ ID NO: 189 - DNA, 470 bp, Homo sapiens
aaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatac

SEQ ID NO: 190 - DNA, 533 bp, Homo sapiens
  misc_feature (275)..(278): n is a, c, g, or t
gtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgannnntgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggct

SEQ ID NO: 191 - DNA, 559 bp, Homo sapiens
  misc_feature (157)..(158): n is a, c, g, or t
  misc_feature (457)..(457): n is a, c, g, or t
gatgacctggaggcactcaaggccaagaacatcaagcagacggaactggtggctgacctccgggaagccatcctgcgcgtggcacgccacttccagtgcacagaccccaaccacgagaactacgtggcgtgctcacgcagccaccggcgccgagccnnggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagcagctccagagccctggccggggccgcgggatatcaatatcaggctgccccactccacgttccccagcacatcccaggtggtgggagcagagggtaccctgccccaccagggtccttagggatgctntaggccaaaccacagtttgtaccaaaaaccttgtgaggaggtgggggagccatgtctgtgctcaggaagagggaaggggatgggggtggctagtaggctcct

SEQ ID NO: 192 - DNA, 462 bp, Homo sapiens
ggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttt

SEQ ID NO: 193 - DNA, 551 bp, Homo sapiens
aagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgc

SEQ ID NO: 194 - DNA, 493 bp, Homo sapiens
ggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatct

SEQ ID NO: 195 - DNA, 532 bp, Homo sapiens
  misc_feature (30)..(30): n is a, c, g, or t
  misc_feature (52)..(52): n is a, c, g, or t
  misc_feature (136)..(136): n is a, c, g, or t
ggatcgggaagcctggtgacaagcccccanccctctgtggggccatccctgnctcaggagactacgtggccagacctggagacaaggtggctgcccgggtgaaggccgtggatggggacgagcagtggatcctggncgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacag

SEQ ID NO: 196 - DNA, 436 bp, Homo sapiens
cggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaa

SEQ ID NO: 197 - DNA, 422 bp, Homo sapiens
acagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaa

SEQ ID NO: 198 - DNA, 477 bp, Homo sapiens
ttggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtg

SEQ ID NO: 199 - DNA, 516 bp, Homo sapiens
caggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggg

SEQ ID NO: 200 - DNA, 393 bp, Homo sapiens
aaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctca

SEQ ID NO: 201 - DNA, 370 bp, Homo sapiens
atgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatt

SEQ ID NO: 202 - DNA, 442 bp, Homo sapiens
tgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcacttctgaggagactacagcaggtgaacagtctacaaggtcttttatcttggataaaatcattgaagaggatgatgcttatgacttcagtacagattatgtgtaacagaacaatggctttttatgatttttttttttaacattttaagcagactgctaaactgttctctgtataagttatggtatgcatgagctgtgtaaatttt

SEQ ID NO: 203 - DNA, 506 bp, Homo sapiens
cacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtata

SEQ ID NO: 204 - DNA, 476 bp, Homo sapiens
  misc_feature (58)..(58): n is a, c, g, or t
  misc_feature (68)..(68): n is a, c, g, or t
tttccttcaacttgtggatgcaggcaaggtggatgatgccagagctctcctacagagnatgtggtgcnaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattt

SEQ ID NO: 205 - DNA, 557 bp, Homo sapiens
ggctttgaaataacaccaccagtgctcttacggttgaagtggggttcagggccagtgcatattagtggacagcacttagtagctggggaggaaaatgcagagtcagaagatgaagaggaggaggatttgaaactcttaagtatatctggaaagccttctccccctggaggtggtagcaagtttccacagaaaaaagtaaaacttgctagtgatgaagatgatgatgaagctgatgatgatgaagatgatggtgatgattttgatgatgaggaaactgaagaaaaagcgccagtgaagaaatctatatgagatactccagccaaaaatgcacaaaattcaaatcagaatggaaaagactcaaaaccagcatcgacaccaagatcaaagaacaaaaatcctacaaaaaacgggaaagaactcctaaaacaccaaaagaaccaagtgctgtagaggacattaaagcaaaaatgcaagcaagtatagaaaaagtggttcccttcccaaagtggaagccaagttcatgatttatgtgaagaattgcttccggatgactgagg

SEQ ID NO: 206 - DNA, 439 bp, Homo sapiens
tctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactga

SEQ ID NO: 207 - DNA, 471 bp, Homo sapiens
ctcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaa

SEQ ID NO: 208 - DNA, 532 bp, Homo sapiens
cctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaa

SEQ ID NO: 209 - DNA, 473 bp, Homo sapiens
  misc_feature (111)..(111): n is a, c, g, or t
  misc_feature (271)..(271): n is a, c, g, or t
gtgaatgcttttgtagtaaccatcttgtagtacctgtgaaatctataactcagaaatggtcagatggtcaggagccagctatgcagcagtataccatctgtttaattattntgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttncattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaat

SEQ ID NO: 210 - DNA, 373 bp, Homo sapiens
aacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggttttgcggctagttggctattcaagaaacctcgcccctctgaatgtcatactgtaat

SEQ ID NO: 211 - DNA, 488 bp, Homo sapiens
  misc_feature (212)..(212): n is a, c, g, or t
cagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccnaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctagtttctctccaccctggaacattcgaga

SEQ ID NO: 212 - DNA, 542 bp, Homo sapiens
aacagtctggatgctggtgccactaatgttgatctaaagcttaaggactatggagtggatctcattgaagtttcaggcaatggatgtggggtagaagaagaaaacttcgaaggctttactctgaaacatcacacatgtaagattcaagagtttgccgacctaactcaggtggaaacttttggctttcggggggaagctctgagctcactttgtgcactgagtgatgtcaccatttctacctgccgtgtatcagcgaaggttgggactcgactggtgtttgatcactatgggaaaatcatccagaaaaccccctacccccgccccagagggatgacagtcagcgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgtagaactgactcctagaagtaccccaccccacccctgctccttggaggacaacgt

SEQ ID NO: 213 - DNA, 482 bp, Homo sapiens
  misc_feature (81)..(81): n is a, c, g, or t
  misc_feature (336)..(336): n is a, c, g, or t
atttcctcatctttttgttgttgtcattgatggtggtgacatggacttgtttatagaggacaggtcagctgtctggctcantgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaantagaaatgtcctgtattccgatgatcatcctgtaaacattttatcatttattaatcatccctgcctgtgtctattattatattcatatctctacgctggaaactttctgcctcaatgtttactgtgcctttgtttttgctagtgtg

SEQ ID NO: 214 - DNA, 492 bp, Homo sapiens
acaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaa

SEQ ID NO: 215 - DNA, 504 bp, Homo sapiens
acttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcac

SEQ ID NO: 216 - DNA, 436 bp, Homo sapiens
  misc_feature (181)..(181): n is a, c, g, or t
  misc_feature (197)..(197): n is a, c, g, or t
  misc_feature (242)..(251): n is a, c, g, or t
atgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttnggcaattgcaagttgncctgcagatagggccgtgatactgtgttttgagccacagaaggtnnnnnnnnnntgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaagg

SEQ ID NO: 217 - DNA, 194 bp, Homo sapiens
caattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcatta

SEQ ID NO: 218 - DNA, 547 bp, Homo sapiens
ggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcag

SEQ ID NO: 219 - DNA, 321 bp, Homo sapiens
gtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggctt

SEQ ID NO: 220 - DNA, 383 bp, Homo sapiens
  misc_feature (314)..(314): n is a, c, g, or t
  misc_feature (323)..(323): n is a, c, g, or t
  misc_feature (328)..(328): n is a, c, g, or t
tcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgntcagaggtngccgnggtggagacagaggtggcttccgtggtggccggggcatggaccgaggtggctttg

SEQ ID NO: 221 - DNA, 405 bp, Homo sapiens
  misc_feature (165)..(165): n is a, c, g, or t
  misc_feature (180)..(182): n is a, c, g, or t
  misc_feature (212)..(212): n is a, c, g, or t
ttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattnggccagtagctaagnnntgggcttttaaagagtattgaagattgaanagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacat

SEQ ID NO: 222 - DNA, 405 bp, Homo sapiens
cttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttt

SEQ ID NO: 223 - DNA, 491 bp, Homo sapiens
  misc_feature (71)..(71): n is a, c, g, or t
  misc_feature (136)..(136): n is a, c, g, or t
  misc_feature (191)..(191): n is a, c, g, or t
  misc_feature (276)..(276): n is a, c, g, or t
tggcccctctaccaatagggcagtagcctcctgccctggatgggtataaggtgggcttggtccaacaggtncccagagggtacatactcctttctggggagagaatgctccctaccatatagttgacagtggttanggaactctccctttccctacctaccttccttttaatagcagaattcctatttttncccttgattatgtgtattgatcaccctgcaatcctattatgtatctgagtgtgtgtgtgtgtgtatgtgtgtgttatgggggaangggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattccccttt

SEQ ID NO: 224 - DNA, 438 bp, Homo sapiens
  misc_feature (31)..(31): n is a, c, g, or t
gtgtgttcatcctagagttatttttttgttngtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattccca

SEQ ID NO: 225 - DNA, 554 bp, Homo sapiens
  misc_feature (33)..(33): n is a, c, g, or t
tgaggattgcttctgccatggagctgatggacntgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgt

SEQ ID NO: 226 - DNA, 531 bp, Homo sapiens
ggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctct

SEQ ID NO: 227 - DNA, 472 bp, Homo sapiens
acttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgtt

SEQ ID NO: 228 - DNA, 153 bp, Homo sapiens
ggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttat

SEQ ID NO: 229 - DNA, 105 bp, Homo sapiens
gccatcactcaaccataacacttgatgccgtttctttcaatatttatttccagagtccggaggcagcagacacgccctcttagtagggacttaatgggccggtcg

SEQ ID NO: 230 - DNA, 522 bp, Homo sapiens
tgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgt

SEQ ID NO: 231 - DNA, 177 bp, Homo sapiens
tccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgcc

SEQ ID NO: 232 - DNA, 493 bp, Homo sapiens
ttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttc

SEQ ID NO: 233 - DNA, 539 bp, Homo sapiens
gcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactgacctctggtcctcaatcgaggttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaa

SEQ ID NO: 234 - DNA, 545 bp, Homo sapiens
aagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacgtttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagcaacagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctga

SEQ ID NO: 235 - DNA, 502 bp, Homo sapiens
  misc_feature (59)..(59): n is a, c, g, or t
  misc_feature (111)..(111): n is a, c, g, or t
  misc_feature (133)..(133): n is a, c, g, or t
  misc_feature (356)..(356): n is a, c, g, or t
aagatccgcagacgtaaggcccggcaagccaaggcgcgccgcatcgccccgcgccccgngtcgggtcccatccggcccatcgtgcgctgccccacggttcggtaccacacngaaggtgcgcgccggccgcggnttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagnctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaag

SEQ ID NO: 236 - DNA, 508 bp, Homo sapiens
tcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaatccctcctttctagctgaacaaaaatgtgcagttaatacttggcgcttgaaaatgcagtagtgaatgtggaaccaagcctgtctgtatatctggtagctccctttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacag

SEQ ID NO: 237 - DNA, 487 bp, Homo sapiens
gatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttagg

SEQ ID NO: 238 - DNA, 449 bp, Homo sapiens
aggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaagtggagcccagtgacaccatcgaaaatgtgaaggccaagatccaagataaagaaggcatccctcccgaccagcagaggctcatctttgcaggcaagcagctggaagatggccgcactctttctgactacaacatccagaaggagtcgaccctgcacctggtcctgcgcctgaggggtggctgttaattcttcagtcatggcattcgcagtgcccagtgatggcattactctgcactatagccatttgccccaacttaagtttag

SEQ ID NO: 239 - DNA, 240 bp, Homo sapiens
accatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagcc

SEQ ID NO: 240 - DNA, 283 bp, Homo sapiens
tggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagctctcaggatggacaagaggaaacccacagctcagcttcaggcttcttatgtttctgaaaac

SEQ ID NO: 241 - DNA, 499 bp, Homo sapiens
gaggccccagggccaatcaatttcaccatgttcctgaccatgtttggtgagaagttaaatggcacagatcctgaagatgtcatcagaaacgcctttgcttgctttgatgaagaagcaacaggtaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattg

SEQ ID NO: 242 - DNA, 467 bp, Homo sapiens
  misc_feature (103)..(103): n is a, c, g, or t
  misc_feature (105)..(106): n is a, c, g, or t
  misc_feature (108)..(114): n is a, c, g, or t
  misc_feature (117)..(124): n is a, c, g, or t
  misc_feature (127)..(132): n is a, c, g, or t
  misc_feature (134)..(137): n is a, c, g, or t
  misc_feature (287)..(287): n is a, c, g, or t
  misc_feature (346)..(346): n is a, c, g, or t
  misc_feature (356)..(356): n is a, c, g, or t
  misc_feature (359)..(360): n is a, c, g, or t
aatccctggattgaagcgcaaagctgaatgaaaacgcccaaaataattagtaggagttcatctttaaaggggatattcatttgattatacgggggagggtcangnngnnnnnnngannnnnnnnagnnnnnnannnntagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattntactttgttgcagatagtcttgccgcatcttggcaagttgcagagatggtggagctagnaaaaaaaaanaanntctgaaatgaaatgtttgtttagacgagatcataccggtaaagcaggaatgacaaagcttgcttttctggtatgttctaggtgtattgtgacttttactgctatatt

SEQ ID NO: 243 - DNA, 537 bp, Homo sapiens
  misc_feature (295)..(304): n is a, c, g, or t
  misc_feature (306)..(307): n is a, c, g, or t
  misc_feature (309)..(310): n is a, c, g, or t
  misc_feature (313)..(314): n is a, c, g, or t
  misc_feature (316)..(317): n is a, c, g, or t
tctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaannnnnnnnnnannanngannanntaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcattta

SEQ ID NO: 244 - DNA, 488 bp, Homo sapiens
tgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatcta

SEQ ID NO: 245 - DNA, 555 bp, Homo sapiens
gatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtaaattttactttgttgcagatagtcttgccgcatct

SEQ ID NO: 246 - DNA, 434 bp, Homo sapiens
ggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctg

SEQ ID NO: 247 - DNA, 498 bp, Homo sapiens
ttgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcc

SEQ ID NO: 248 - DNA, 287 bp, Homo sapiens
gaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactg

SEQ ID NO: 249 - DNA, 447 bp, Homo sapiens
gcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggg

SEQ ID NO: 250 - DNA, 570 bp, Homo sapiens
ccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttc

SEQ ID NO: 251 - DNA, 429 bp, Homo sapiens
atcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaa

SEQ ID NO: 252 - DNA, 413 bp, Homo sapiens
gtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacac

SEQ ID NO: 253 - DNA, 349 bp, Homo sapiens
ataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagatatgtaaaaagtcataaaatgtatcttccatgctacatgtacaataagaacttctataattgtatatatgcctttgatgtattttcccctcaagattatcaactgtgtgttcgacagtgaatattcaatctggtaccagtt

SEQ ID NO: 254 - DNA, 562 bp, Homo sapiens
ccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcacctt

SEQ ID NO: 255 - DNA, 559 bp, Homo sapiens
gttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatcttgaggctctgaggcactgttaacgcacaatgttcacagacatctgttgctgcctcaccttgggatccctgccacaagttccttgggcagtggccatgtcaccattgagatgaagatatacaacagagaaatagtggctgtgtttgggaagcttcagccctgcacattttgaactagtcactctcccagacttggcggtgggtcagttctttcctgagtagaggacttgctggtaaaaggggcagatgctttttattagtactgattaaaccacactgagggaaacatccctcttagctgggaaactgtttactcttcaggagcttggcatcatggactgttaatgtatgtgattttccccctatt

SEQ ID NO: 256 - DNA, 526 bp, Homo sapiens
ccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaa

SEQ ID NO: 257 - DNA, 516 bp, Homo sapiens
  misc_feature (158)..(159): n is a, c, g, or t
tttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgnntatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaac

SEQ ID NO: 258 - DNA, 503 bp, Homo sapiens
gtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccagaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcc

SEQ ID NO: 259 - DNA, 522 bp, Homo sapiens
tacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgat

SEQ ID NO: 260 - DNA, 556 bp, Homo sapiens
tacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcacattaaatagtgacctttttcagtattttccctcttcccctttataaattatgctaaagccacaaagcacatttttggggatcatagaaggttggggttccagaaaggcatctgtgtgatggttccattgatgtgggatttccctacttgctgtattctcagt

SEQ ID NO: 261 - DNA, 430 bp, Homo sapiens
cattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgt

SEQ ID NO: 262 - DNA, 531 bp, Homo sapiens
gatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctca

SEQ ID NO: 263 - DNA, 373 bp, Homo sapiens
aagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactatttt

SEQ ID NO: 264 - DNA, 298 bp, Homo sapiens
gaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaata

SEQ ID NO: 265 - DNA, 506 bp, Homo sapiens
tgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtag

SEQ ID NO: 266 - DNA, 501 bp, Homo sapiens
agtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctctagcccttctattctcccaaggagagagattcccatttctcctcggccattgtacctagctcttgtccctagctgcatttcagtggaccatggatagagggactgagggttagacggagaagactggcagggaggcacgcaggtactgtgaaaatccttccctttgc

SEQ ID NO: 267 - DNA, 472 bp, Homo sapiens
gaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaa

SEQ ID NO: 268 - DNA, 473 bp, Homo sapiens
gcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgca

SEQ ID NO: 269 - DNA, 539 bp, Homo sapiens
tttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccag

SEQ ID NO: 270 - DNA, 521 bp, Homo sapiens
ccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtg

SEQ ID NO: 271 - DNA, 348 bp, Homo sapiens
agaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtccctccaggttactaaagggtgcatgtcccctgcttgaacactgaagggcaggtggt

SEQ ID NO: 272 - DNA, 564 bp, Homo sapiens
  misc_feature (26)..(26): n is a, c, g, or t
  misc_feature (82)..(83): n is a, c, g, or t
  misc_feature (159)..(159): n is a, c, g, or t
  misc_feature (180)..(204): n is a, c, g, or t
  misc_feature (272)..(272): n is a, c, g, or t
  misc_feature (445)..(469): n is a, c, g, or t
gtctcacccaagtgctccggagagtnacaggaaacccacggctccccgcgcccaagagcgtcctgcggtctcgctggcacanngccccgtacactagggggtcctacagctacgtggccgtgggcagtactgggggcgacctggacctgctggctcagnccctccctgcagacggcgccnnnnnnnnnnnnnnnnnnnnnnnnncgggggaagccacacatcgcacgttttactccacgacgcacggggctctgctgtcgggatggagggangccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctgnnnnnnnnnnnnnnnnnnnnnnnnntcagttcttgtgtctgttattggagtctggccagggttgacttgagctgagacaccagatgctcacggagatgctggacacataaagcaagttac

SEQ ID NO: 273 - DNA, 487 bp, Homo sapiens
cggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctc

SEQ ID NO: 274 - DNA, 467 bp, Homo sapiens
tatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgt

SEQ ID NO: 275 - DNA, 505 bp, Homo sapiens
atacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgct

SEQ ID NO: 276 - DNA, 549 bp, Homo sapiens
  misc_feature (29)..(29): n is a, c, g, or t
  misc_feature (43)..(43): n is a, c, g, or t
  misc_feature (74)..(74): n is a, c, g, or t
  misc_feature (93)..(94): n is a, c, g, or t
  misc_feature (97)..(97): n is a, c, g, or t
atcctccaaacttccaatctatattattngtaatgagaacttnggtgggggaaaaaaagcattaagagaatttnggatgtaaaggcatctggnntcngatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaac

SEQ ID NO: 277 - DNA, 275 bp, Homo sapiens
cctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggccca

SEQ ID NO: 278 - DNA, 387 bp, Homo sapiens
  misc_feature (166)..(166): n is a, c, g, or t
ccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtncgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcatt

SEQ ID NO: 279 - DNA, 562 bp, Homo sapiens
gcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagccagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatatagatttctcattgtttgggttggaatacaccattgtttatttttgttcctttgtcttctggcttttcagctgttctttgtagtccct

SEQ ID NO: 280 - DNA, 46 bp, Homo sapiens
agcttccccaactaaagcctagaagagcttctgaggcgctgctttg

SEQ ID NO: 281 - DNA, 546 bp, Homo sapiens
  misc_feature (104)..(104): n is a, c, g, or t
ttctatgcatccacaccaaaatcctgcagaatgtaagtaagctctgctttataagatgggttcaccttcatcgcagactgaaagtttcagtttttatttttttncagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgac

SEQ ID NO: 282 - DNA, 525 bp, Homo sapiens
gtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacct

SEQ ID NO: 283 - DNA, 318 bp, Homo sapiens
gagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaattta

SEQ ID NO: 284 - DNA, 427 bp, Homo sapiens
  misc_feature (26)..(26): n is a, c, g, or t
  misc_feature (75)..(75): n is a, c, g, or t
tataggagccatgtaagcacgcagtngggtgaactgcttaatttcactacatgttgatgtacttgtcttccgtcntgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtg

SEQ ID NO: 285 - DNA, 208 bp, Homo sapiens
ttgtcacgagtgccgtgccgtgtaataaagtcccagtgctcatccaccacagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctg

SEQ ID NO: 286 - DNA, 276 bp, Homo sapiens
  misc_feature (57)..(57): n is a, c, g, or t
aaaaatggcgttcttctcttgtggcctgttattctgattgctgctgtatacagtttngtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgt

SEQ ID NO: 287 - DNA, 541 bp, Homo sapiens
tttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccatttacattttttttctaaatataataaaaacttacctggcatcagcctcata

SEQ ID NO: 288 - DNA, 507 bp, Homo sapiens
  misc_feature (275)..(275): n is a, c, g, or t
aactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggnatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatg

SEQ ID NO: 289 - DNA, 240 bp, Homo sapiens
ggttgtgaccagggttgtgaccggggtgtaccccaggtgcctccacgcatctcagtggccggtctgtgctgcctgcccagtcaggaagttttggtctgtaggatgaggggccttcatgacatgggggtcacagtccgagacttgtgggagtgtgggtctccatggcaggagggcacctgccaatgctgggcacggttgggtgttagctaggcctgggtgaacagtgaacttttgtcctac

SEQ ID NO: 290 - DNA, 446 bp, Homo sapiens
gacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtac

SEQ ID NO: 291 - DNA, 385 bp, Homo sapiens
agcgtttcaaccgtggcatttgctctctgcattccagttagcaaatggggtaaggcgttaggaatttatcaccaaatggaaagaacataatgtgagctgaagcccttgggactgcttccagaggtcctggtgtgggcgttcctcccagcaaggccaggtccatccctgtggagagaagcagctgcctagacttgggcttaatgggggagcttctgccctgttgagagcatagcctgggttttcatcttttatgtttcttcagtgactatctacaggcaccatgacagtgttcccaacaaggcagaaatcagcctggtctctccttccctgctcctggttgactgcccgtgacatgacaaaacattggcagtggtggcgcagagat

SEQ ID NO: 292 - DNA, 431 bp, Homo sapiens
gaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacac

SEQ ID NO: 293 - DNA, 480 bp, Homo sapiens
caggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcat

SEQ ID NO: 294 - DNA, 520 bp, Homo sapiens
aatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagcctggggtccatccccttcccccatccctaccactgtgcgcaagaggggcgggctcagagctttgtcacttgccac

SEQ ID NO: 295 - DNA, 520 bp, Homo sapiens
  misc_feature (143)..(143): n is a, c, g, or t
  misc_feature (178)..(179): n is a, c, g, or t
gggagatctgcagaagcatcagaccaggcagggcctcgtacgcagtcctgaggagttttacttttattctaagacagttggggagctccaggagctgttttaagttggggagagactggattccagcctgcaaaagctgtttngtgaagactaaaaccagtgaggagaggtggaggtnntttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctc

SEQ ID NO: 296 - DNA, 385 bp, Homo sapiens
taatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttcca

SEQ ID NO: 297 - DNA, 452 bp, Homo sapiens
tagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtgga

SEQ ID NO: 298 - DNA, 341 bp, Homo sapiens
  misc_feature (86)..(86): n is a, c, g, or t
  misc_feature (106)..(106): n is a, c, g, or t
  misc_feature (109)..(113): n is a, c, g, or t
  misc_feature (115)..(115): n is a, c, g, or t
  misc_feature (120)..(120): n is a, c, g, or t
  misc_feature (125)..(126): n is a, c, g, or t
  misc_feature (128)..(128): n is a, c, g, or t
tcactcattcacaacagtcgatgtgaggaggagcctttacacctgtggagacagtgatagctttggagcagataaggtggagctgntcatttttgctggatttggnggnnnnntncccgnccccnncncccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccat

SEQ ID NO: 299 - DNA, 329 bp, Homo sapiens
  misc_feature (77)..(77): n is a, c, g, or t
  misc_feature (260)..(261): n is a, c, g, or t
cttcatcccagctctgtgtgtggaggacaaagcttcttcctgcgtggctccaggaaaagatgtggctcacgtaggtngcacctgccaatagctttgtcaatcacagccccataggaacgtctggaattgcttgggagttggggagaactgtcaagaagagtgaagagagtgccaaagcggagatctgttcacctgggtggaggggaccactaagatcaagatcaaagattctccccatctcacagacaaggaaactgagnnagagggaggagagaattgctcatggctccagaactggtggcaagtttctctggactcttaggtttatt

SEQ ID NO: 300 - DNA, 116 bp, Homo sapiens
ccctgggtatcatgtccacatgcccagcaagagccttgcctcccctgcctcccctcctttttcctgtccacctatatgaccaatccctaattgctgtcctgatgatgagtcattcc

SEQ ID NO: 301 - DNA, 534 bp, Homo sapiens
aggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgagctcccccaccctgacagtgagatgtgtcttcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcagggtgggctcagaggccactgagatgccagttccttgagagcagtgggggtgtcccaggccagagcagcctcttcctctcctggtcccagaaaaacccttgcagtaaatggtggcctc

SEQ ID NO: 302 - DNA, 473 bp, Homo sapiens
  misc_feature (207)..(207): n is a, c, g, or t
  misc_feature (434)..(434): n is a, c, g, or t
agacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggatttttttttttttnccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttcctttttttttttttttnctgatttgattctggttacagtgccataaaccttgttac

SEQ ID NO: 303 - DNA, 191 bp, Homo sapiens
tcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggag

SEQ ID NO: 304 - DNA, 512 bp, Homo sapiens
gcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagac

SEQ ID NO: 305 - DNA, 358 bp, Homo sapiens
tgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgt

SEQ ID NO: 306 - DNA, 529 bp, Homo sapiens
ccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaa

SEQ ID NO: 307 - DNA, 521 bp, Homo sapiens
cccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagt

SEQ ID NO: 308 - DNA, 533 bp, Homo sapiens
  misc_feature (28)..(28): n is a, c, g, or t
gtgttccacatcattgacttactgcttngtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaa

SEQ ID NO: 309 - DNA, 280 bp, Homo sapiens
aatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagc

SEQ ID NO: 310 - DNA, 432 bp, Homo sapiens
  misc_feature (405)..(405): n is a, c, g, or t
atgttggccaggctagtcacgaactcctaacctcaggtgatccacccacctctgcctcccaaagtgctgggattacaggcatgagctaccacacctggtttggagagtcttaattaagtgaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttattttgagcctttcttttatgagtaaatgattcctccttgttctgtctttcaaaccagctaaatatttgtcacaaaagtgncttttttctcactgttgcctattttca

SEQ ID NO: 311 - DNA, 390 bp, Homo sapiens
ggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaa

SEQ ID NO: 312 - DNA, 452 bp, Homo sapiens
acccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcgtttattttccaaatgagcagtttagaaatatgtgatgtaaagtacatactgtacgtttgctgaaaa

SEQ ID NO: 313 - DNA, 553 bp, Homo sapiens
agatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactaccctttttctgttttatcatgtattcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagag

SEQ ID NO: 314 - DNA, 535 bp, Homo sapiens
gaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctccagcccgcagctccaggagtctgtcttccacctgctggtgcccagtgtcatcctggtcttgctggctgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctcttcgtgggaggagacattatggggcgtccaccaccacccctccctggccatcctcctggaatgtggtctgccctccaccagagctcctgcctgccaggactggaccagagc

SEQ ID NO: 315 - DNA, 516 bp, Homo sapiens
aatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatga

SEQ ID NO: 316 - DNA, 367 bp, Homo sapiens
gtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggt

SEQ ID NO: 317 - DNA, 556 bp, Homo sapiens
acatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaac

SEQ ID NO: 318 - DNA, 287 bp, Homo sapiens
caaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgcc

SEQ ID NO: 319 - DNA, 527 bp, Homo sapiens
aagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggaatcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttct

SEQ ID NO: 320 - DNA, 363 bp, Homo sapiens
aaacttcagttcagccaggatcaagtggtatggcttccgttattgttagcaacactgaccctcagtcttctcctgtaaaaactaaaaagaagacggctatgaacactagagattccagactcccttgcagcaaggattctagctgaaaatatgttcgactgacttccaggagttccgaaaggcagaagtgaggctaggccatatgtgcattgtggctgtagatgctagcaagcaatgtcatcaactgtcaggttgtttttcacagtgacatctcatcagctccctattgtcaagaagtagctccaaagtctttgagccctttcccagtcaaatgctcccaacagggcatcccttattctgacc

SEQ ID NO: 321 - DNA, 526 bp, Homo sapiens
cttgcaggcatctgtctttttactggagagatttaaagaattctcttgctgtttggattattcctctacagattgtcattttttaaaccctttgttctctctcatttgacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctg

SEQ ID NO: 322 - DNA, 439 bp, Homo sapiens
tgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaacttgcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaa

SEQ ID NO: 323 - DNA, 500 bp, Homo sapiens
ctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcata

SEQ ID NO: 324 - DNA, 122 bp, Homo sapiens
ccaagcaggctgccacgcagagtgagctgcactacgcaaatctggagctgctgatgtggcctctgcaggaaaagccagcaccaccaagggaggtggaggtggaatacagcactgtggcctcc

SEQ ID NO: 325 - DNA, 525 bp, Homo sapiens
tcatgcatctgttctacgtgcgggcgggagtgtctcgtgccatgctgctgcgcttcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagtggttgcgtggagcccccgcccagctggaagccccagcagatgccaccgccagaagagcccttatgacccctgggccacgctgtgccttagtgtctacttgcaggacccttcctccttccctagggctgcagggcctgtccacagttcctgtgggggtggaggagactcctctggagaagggtgagaaggtggaggttatgctttggggggacaggccagaatgaagtcctgggtcaggagcccagctggctgggcccagctgcctatgtaaggccttctagtttgt

SEQ ID NO: 326 - DNA, 567 bp, Homo sapiens
gagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattat

SEQ ID NO: 327 - DNA, 536 bp, Homo sapiens
tagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctactggaccgtgagccaatt

SEQ ID NO: 328 - DNA, 535 bp, Homo sapiens
gaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagtttt

SEQ ID NO: 329 - DNA, 436 bp, Homo sapiens
tatagctctctttagctcaaccactctgtccatccagccaatggatgtccttccctgtacccaattcaagcttattttagggaagccttgaaactaccatgtatctggctctagctgagttattgaggattgagccagtgcaacgttaaactcagtgcacttacatttgatttaaatgatggttttatctgttgtgtgaagtggttcacccttgaggaccaggagcctccatatcctgactgaaaaccttttctgagacttagagtaacagtacttttggttccttgagttctcctgtctccagatacctaaatgaccttgacttttctgccttgtgaattcgtagtccaatcagctgaaattaaatcacttgggagggacgcatagaaggagctctaggaacacagtgccagtgcagaagtttctccaggtggcc

SEQ ID NO: 330 - DNA, 467 bp, Homo sapiens
tataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgtt

SEQ ID NO: 331 - DNA, 453 bp, Homo sapiens
  misc_feature (406)..(406): n is a, c, g, or t
ggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttnaacagtgttttgtagatttcagatgactatgcagaggcctgggggac

SEQ ID NO: 332 - DNA, 167 bp, Homo sapiens
gaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggt

SEQ ID NO: 333 - DNA, 232 bp, Homo sapiens
ttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgt

SEQ ID NO: 334 - DNA, 512 bp, Homo sapiens
  misc_feature (169)..(169): n is a, c, g, or t
cccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggnttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggc

SEQ ID NO: 335 - DNA, 500 bp, Homo sapiens
tcccctgtgccgaagtgagtgccacttgtctgcagggccgtaccgcggaaccctctttgccgaccagccagtgatgtttgtctcgcctgccagcagccccccagtggccaagctctgtgaactagtccacctgtgcggaggccgggtcagccaagtcccccgccaggccagcatcgtcatcgggccctacagcggaaagaagaaagcaacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggc

SEQ ID NO: 336 - DNA, 541 bp, Homo sapiens
tggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggt

SEQ ID NO: 337 - DNA, 307 bp, Homo sapiens
gtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcaga

SEQ ID NO: 338 - DNA, 475 bp, Homo sapiens
  misc_feature (288)..(288): n is a, c, g, or t
  misc_feature (295)..(295): n is a, c, g, or t
  misc_feature (313)..(314): n is a, c, g, or t
gacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtnggagganaaggaggaagaggagganngccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactg

SEQ ID NO: 339 - DNA, 543 bp, Homo sapiens
ctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttg

SEQ ID NO: 340 - DNA, 466 bp, Homo sapiens
actggactggctgaaggacgacctctgcacagatcccaaggtccccttcagttggtcacaagaggaaatttctgacctgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacactgagacacttggacgtcacatgtgaagcctacgatcacttccgctcctgcctgcacgcgctggagcagctcacagatggcaagctgcgcttcgtggtggagcccgtggaggcctccttcccacagctcctggtttacgagcgcctccagcagctggagctctggaagatcatcgcagaaccagtaacatgacccatcgcctccaccaggcgcggcgtctcgactgttcttagagtg

SEQ ID NO: 341 - DNA, 342 bp, Homo sapiens
caatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattaca

SEQ ID NO: 342 - DNA, 448 bp, Homo sapiens
  misc_feature (29)..(29): n is a, c, g, or t
  misc_feature (73)..(73): n is a, c, g, or t
  misc_feature (107)..(107): n is a, c, g, or t
cctctgagtcccagggacctgggcaggcncaagcccaccacgagcatcatccagtcctcagccctaatctgcncttaggagtccaggctgcaccctggagatcccanacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatac

SEQ ID NO: 343 - DNA, 555 bp, Homo sapiens
gggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatc

SEQ ID NO: 344 - DNA, 468 bp, Homo sapiens
gaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataa

SEQ ID NO: 345 - DNA, 210 bp, Homo sapiens
aagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaa

SEQ ID NO: 346 - DNA, 425 bp, Homo sapiens
tcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaa

SEQ ID NO: 347 - DNA, 541 bp, Homo sapiens
  misc_feature (359)..(359): n is a, c, g, or t
actctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctnccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgcctta

SEQ ID NO: 348 - DNA, 329 bp, Homo sapiens
cacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatat

SEQ ID NO: 349 - DNA, 124 bp, Homo sapiens
gaaactgaacctttcggcttcatgcttaatgtatttgttttctgctgctgcatcttggttataccattactgagtgcattttggtgtgcctatctctgatggatgattgattgcttttaaaact

SEQ ID NO: 350 - DNA, 425 bp, Homo sapiens
tataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactg

SEQ ID NO: 351 - DNA, 493 bp, Homo sapiens
atgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcct

SEQ ID NO: 352 - DNA, 356 bp, Homo sapiens
gaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcc

SEQ ID NO: 353 - DNA, 491 bp, Homo sapiens
tgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagca

SEQ ID NO: 354 - DNA, 532 bp, Homo sapiens
tagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagt

SEQ ID NO: 355 - DNA, 477 bp, Homo sapiens
gtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtt

SEQ ID NO: 356 - DNA, 564 bp, Homo sapiens
cattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaata

SEQ ID NO: 357 - DNA, 534 bp, Homo sapiens
gagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaa

SEQ ID NO: 358 - DNA, 509 bp, Homo sapiens
aatgaggaaggcaccgaagcagctgcgaccactgcagtgatcaggaatacccggagctgcagaatagagccaaggttctgtcgtgaccgcccattccttttcttcatctggcaccagaaaaccagcagcatcttgttctgtggcaggttctcttctccataatgtccttatggggttgaggatgtggttcagttggcggagtgtttgcagaacaagcacaaggccctagctcagccctaagcaccctatgaagctaggcatgattgtgcctacctgccatcctagcatttgggaggtgcaggatgagtgagtcacacattcaaggtcatcctaaatgacacaggactctgtctcaaatgacacaggactctgtctcaaacaccaccaccaccaccaccaccaccaccaccaccaccaccaccaccgccaacaacaacaacaacaataacaataaaaaacaagaaagtagatgtgtgattgattgacacatcattctctgctgaattctg

SEQ ID NO: 359 - DNA, 554 bp, Homo sapiens
cagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaat

SEQ ID NO: 360 - DNA, 538 bp, Homo sapiens
gaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtt

SEQ ID NO: 361 - DNA, 475 bp, Homo sapiens
tcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcattccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccc

SEQ ID NO: 362 - DNA, 540 bp, Homo sapiens
gaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttatt

SEQ ID NO: 363 - DNA, 536 bp, Homo sapiens
gaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctga

SEQ ID NO: 364 - DNA, 459 bp, Homo sapiens
aagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaa

SEQ ID NO: 365 - DNA, 438 bp, Homo sapiens
  misc_feature (27)..(27): n is a, c, g, or t
agattgatcatgtctacctgatgcgcngtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatc

SEQ ID NO: 366 - DNA, 459 bp, Homo sapiens
  misc_feature (164)..(164): n is a, c, g, or t
ggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaangttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatact

SEQ ID NO: 367 - DNA, 409 bp, Homo sapiens
aacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctg

SEQ ID NO: 368 - DNA, 507 bp, Homo sapiens
gcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaa

SEQ ID NO: 369 - DNA, 395 bp, Homo sapiens
tgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatggactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaat

SEQ ID NO: 370 - DNA, 534 bp, Homo sapiens
  misc_feature (270)..(270): n is a, c, g, or t
atcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcnttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaa

SEQ ID NO: 371 - DNA, 411 bp, Homo sapiens
tgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatc

SEQ ID NO: 372 - DNA, 426 bp, Homo sapiens
ccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtgggaggctgtctgtgtccaggaaacttaattccctggtgactagagctttgcctggtgat

SEQ ID NO: 373 - DNA, 547 bp, Homo sapiens
gacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaa

SEQ ID NO: 374 - DNA, 488 bp, Homo sapiens
cctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtat

SEQ ID NO: 375 - DNA, 394 bp, Homo sapiens
ttgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcaga

SEQ ID NO: 376 - DNA, 245 bp, Homo sapiens
aagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcct

SEQ ID NO: 377 - DNA, 245 bp, Homo sapiens
  misc_feature (34)..(59): n is a, c, g, or t
  misc_feature (177)..(177): n is a, c, g, or t
  misc_feature (179)..(180): n is a, c, g, or t
tcctttgtggccttaacccttctgcatcagggannnnnnnnnnnnnnnnnnnnnnnnnnacctcatgggaccagaccccttgggaccacatggcacaatgggacctctgttgtacattccggttgggggatgagcgttgctatttaattactaatattattgaatgccttagaggangnngggcgagcccggtgttctgaagacctgtggcccagcagagcctctgacagtaaagttttgctcca

SEQ ID NO: 378 - DNA, 446 bp, Homo sapiens
ggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaacc

SEQ ID NO: 379 - DNA, 488 bp, Homo sapiens
agaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatg

SEQ ID NO: 380 - DNA, 475 bp, Homo sapiens
attccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtat

SEQ ID NO: 381 - DNA, 438 bp, Homo sapiens
aatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggca

SEQ ID NO: 382 - DNA, 530 bp, Homo sapiens
aagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgatt

SEQ ID NO: 383 - DNA, 462 bp, Homo sapiens
  misc_feature (64)..(65): n is a, c, g, or t
  misc_feature (115)..(115): n is a, c, g, or t
  misc_feature (121)..(121): n is a, c, g, or t
  misc_feature (422)..(422): n is a, c, g, or t
  misc_feature (432)..(432): n is a, c, g, or t
gggggctcagtgagcactactcacagatccacacctgaccctgttgggtcgagtcaggctgggnnttggtctgcactgtagcacctgtgttctttgagttcacatcatgaatgtnggtganttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttnctaacgccanatattgaaggccaacataactggtggacag

SEQ ID NO: 384 - DNA, 463 bp, Homo sapiens
aaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagc

SEQ ID NO: 385 - DNA, 425 bp, Homo sapiens
agttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacgaagacgagatgtcacagaggtccactcagtgacacacactgaaggcctgagggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcc

SEQ ID NO: 386 - DNA, 398 bp, Homo sapiens
acccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttca

SEQ ID NO: 387 - DNA, 528 bp, Homo sapiens
ttagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaag

SEQ ID NO: 388 - DNA, 532 bp, Homo sapiens
gtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaa

SEQ ID NO: 389 - DNA, 522 bp, Homo sapiens
tcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgt

SEQ ID NO: 390 - DNA, 496 bp, Homo sapiens
ttgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgccaaaatgagttgtgatgaatcaatgaaaaatgtaatttagaaactgatttcttcagaattagatggccttattttttaaaatatttgaatgaaaacattttatttttaaaatattacacaggaggccttcggagtttcttagtcattactgtccttttcccctacagaattttccctcttggtgtgattgcacagaatttgtatgtattttcagttacaagattgtaagtaaattgcctgatttgttttcattata

SEQ ID NO: 391 - DNA, 523 bp, Homo sapiens
ggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggtccaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggt

SEQ ID NO: 392 - DNA, 343 bp, Homo sapiens
ttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgta

SEQ ID NO: 393 - DNA, 220 bp, Homo sapiens
gacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatactt

SEQ ID NO: 394 - DNA, 566 bp, Homo sapiens
gatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgctgc

SEQ ID NO: 395 - DNA, 563 bp, Homo sapiens
tgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgca

SEQ ID NO: 396 - DNA, 444 bp, Homo sapiens
gaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagc

SEQ ID NO: 397 - DNA, 466 bp, Homo sapiens
tcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccc

SEQ ID NO: 398 - DNA, 539 bp, Homo sapiens
cacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatc

SEQ ID NO: 399 - DNA, 542 bp, Homo sapiens
actcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttcct

SEQ ID NO: 400 - DNA, 544 bp, Homo sapiens
agtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatga

SEQ ID NO: 401 - DNA, 326 bp, Homo sapiens
gagaagacacaaatccctgatactgtcaatggtggaaattctggaaacttggatggggaaaagccaccagagaagaaatgtatctgctagactctacatagaaactgaacatcaagaaccccaccaaaatattacttttaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatgg

SEQ ID NO: 402 - DNA, 437 bp, Homo sapiens
ctgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctacaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatt

SEQ ID NO: 403 - DNA, 552 bp, Homo sapiens
aacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagaatattcagattgtgtagatatgctatttaaataatttatcaggaaatactgcctgtagagttagtatttctatttttatataatgtttgcacactgaattgaagaattgttggttttttcttttttttgttttttttttttttttttttttttttgcttttgacctcccatttttactatttgccaatacctttttctaggaatgtgcttttttttgtacacatttttatccattttacattctaaagcagtgtaagttgtatattactgtttct

SEQ ID NO: 404 - DNA, 525 bp, Homo sapiens
gtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagttt

SEQ ID NO: 405 - DNA, 525 bp, Homo sapiens
gatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaacggtaattacaacatattatcagtcacagttttctttccaattaaacacttaacttttgttattccctgtatataaat

SEQ ID NO: 406 - DNA, 156 bp, Homo sapiens
ggagcatatcaagtaagaggcgtcgccaccaccctcccgagggcccctctgcggatggagccccaggtgcaacagggcccatggtcatctgtggagggacagcccgtgtggaaactgcatttatcttcttgacctgatacccatgcagtaaatgaa

SEQ ID NO: 407 - DNA, 3040 bp, Homo sapiens
catcagcttcctgagaaacctttactataatggattgtaaaaataactactttaaggacaaatttcttaattgtaaatgctgcaaaatgaaggagcttgtttgggttgatgcaggacccacagcaattaaacaattgctgacgagtatatgtgatccagatgcacaggaggttattcttgcaaccagcctattggaccagatgatcttggtaccacccagatcaataaactggctcatctgatcttgtggcaccccctacccaggaactgactgagcgcaagaagacagctttgactccctatgatttaatctctaaccaatcagcactcctggctcactggcttcctcccacccaccaaattattcatagaaactctgatccctgaatgctcagggagactgatttgagtaataataaaactctggtctcccacacagctggctccatgtgaattactctttctcttgcagttcccctgtcttgatgaattggctctgtctaggcagtgggcagggtgaaccccttgggcggttacagtggtatgggacaaaattaagatttggtggccattgatgttgcctctggccacatctcctctggggagaatgtaaatcaaaaataaaattggaaccctcccccacccccaaccatcttaatggactcccttcttggccagggcactaaaatttaacctgaaagactggtcaggctggccggcgcggtggctcatgcgtgtaatcccagcactttaggagcccgaggcaggtggatcgcctgaggtcaggagttcgagaccagcctggccaacatagtgaaactaaaaaatacaaaaaattgtctttactaaaaaatacaaaaaattagctgggcgtggtggtgggcgcctataatcccagctacccaggaagctgaggcaggagaatcacttgaacctgggaggcggaggttgcagtgagctgagattgcgccattgtactccagggcaacaagagcgaaactgtgtctcaaaaaaaaaaaaaaaaagaaagaaagaaagaaagactggtcaggccgtaatgggaactgggagtcagacaggcttcattttacccctccagcattaacatcaacagaccttaagtgtgataacaattacagtctattttctctgaagcttgctacctggaggcctcatctgcatgacaaaaccttggtcttcataacccttatcttaacccagacactcctttctactgataataactctttcaaccaattgctaatcagaatatgtttaaatctaccgatgacctggaagcaccttgcctttgagttgtcccacccttccagatcaaaccaatgtaaattttacatgtgttgactaatgtattatgtctccctaaaacgtacaaaagcaagctgtacccggaccacctggcctcaggacctcctgagtctgtttcactggtgcgtctttaatcttggcaaaataaaatttctaaattgacagagacttgtctctgatattttgagttcacaaaggtgatattgttggccaaatgtgcctcttactatttttttcttttcaatagcttctgcttatgtctgtcactgcttcttttgctactactaattattttaggtgaactcagactagttttacttctggatagtgatgtgaaaactgagattatcagaagtctgctctctgattcttgctttacttggactagaccttttttagacaccatagtattgtacattaatctccactagtataaacttcgtgagtcaggaacacatccccagagccctggcacaaaaagaaatcttgataaatattgtaaaatgaatgaatttactttgtgacatttcaagtttcttgaggacagaaacagtgtcttactccttatgtccctttaaaatttaatatattttaaaatatttgagtaattttttgaataggatatatatatcatatgtatatcatacatggcacaaatatgtgtgtgtgtatatgtatttgtgctatatatatatatttgtgctctctctatatatatatagagagagagagagcacaaatttgcaaaggtacaaagaggtatacggtgaaacaggaaacaggaatccctgtccaccagccacccagctgagaaaccctcctggagcgaacatcattattcattttttggtgtctctttccagaaatgttctgtgcatgcacaagtatttacatacatatcttcaaatgcaaatggtagtatactttctagatacttttttacattgcatttaacattagaacatgtagagcagcctcgttccttttaaagactgcaaagtattcggaatggacataccacatttaaaaaaaactagtcttctattgatggacctttatattgtttccaaagttttgctgttttggaaaatgctactgtgaatttccttgtttgttgctttacaaattggcagatttctctgtagaataaattcctacaagtgcaattgccggcttaaagggtactatgtgtgttttacgtattgagagatattggcaaattggccttaaagagttctattgactatttatagttctactaatgatttatacagtattttgttaacacggccttttggtctggaaataattacactgtaagacagtacagttgaaatatcaaagaaattaaaacaaagttaggtatgtcataattatatgaaatatgtgtagacactagtccattttatcatttgctaccataaaatatgcacacatctgttatacaaagttaaaatttatcaaaacatagaaacacagaacatgcatagcataatttgtggttgagaaatgtaaacaagtgtaaagatgcagtattattacgcatataataactgtagtccatgctgtactactgtaataattttgtagccacctcttgttgctgttgtgactcactcagtgttgacactcatcaccttcttgtgaacagttcatctcttcagtaaattgtgttttaacattaaaaagtgatctctcgcaaaaaaaaaaaaaa

SEQ ID NO: 408 - DNA, 2928 bp, Homo sapiens
ggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctgtggtgctgcagtcgatcctcagcctgatggacaggggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaaaaaaaaaaaaaaaaa

SEQ ID NO: 409 - DNA, 468 bp, Homo sapiens
  misc_feature (15)..(15): n is a, c, g, or t
  misc_feature (35)..(35): n is a, c, g, or t
  misc_feature (51)..(51): n is a, c, g, or t
  misc_feature (66)..(66): n is a, c, g, or t
  misc_feature (79)..(80): n is a, c, g, or t
  misc_feature (94)..(94): n is a, c, g, or t
  misc_feature (109)..(110): n is a, c, g, or t
  misc_feature (143)..(143): n is a, c, g, or t
ctaacagggaataangcttgcggcccgcaatgctntttttttttttttttnttttattctttaagngtaatttattcanngctgatttttaagntgaagggagctcagnnttagtcaatatcctaccactcttgaaagctccncttccaatgtaattttcatagtctttacattttaactgtcattgtttattactgttttggctatactctctacaatttcagcagcattttaaagagacaatgtgtctatgtacaatgaaaaaacaaaatggcttgcaacatcagaaatacagtttaactgtacaatattaaagagaatccgtggtacgtataacctttttctgcaacatgaacaacttacatgtaagtatcagcattatgaatgtgacaataaagaaaaagtccttacaggagtgaaatacagcatcctgaaaaatattggtttctaccctacgaggcagttaga

SEQ ID NO: 410 - DNA, 511 bp, Homo sapiens
aagcagagagaatatggatttaattgtttaccataagaaaagtgacatatccaaccaaccatccatccccacctgtgccctattctttccttgtgtttctttagagccttttcagctatttcctgtgaagcaaactgcacgaaggcctcccccgtactcctcccctggaagtccaccggcaatgttatcccatttggcacgatttccaacccttcaacccaaggacaaataaccccagtaggggggcaatattaacatcacaagcccagaaatgattcttcttatagctttaaataaaccagaatttttaactttaggtgaatggtatgctttcaacaagtactctttaaatatgcattgcaataatatgaagttccattattataaagtataactattcttaacacacccatggtacagtatatattaaaaaaaacttgctgaacacaggatgcattaagaattcaacaacttaagaacacatatctatgcaacttaatgttgagaatat

SEQ ID NO: 411 - DNA, 6271 bp, Homo sapiens
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtcaaaaaaaaaaaaaaaaaaaa

SEQ ID NO: 412 - DNA, 381 bp, Homo sapiens
tacctatacatggaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatagatctaacttcccagggggcaggcacttactggtatttacctcctgagtgttttgtagttggaaaagagccaccaaagatttccaacaaggttgatatgtggttccattgg

SEQ ID NO: 413 - DNA, 2306 bp, Homo sapiens
ggaggcaggagaatcgcttgaaccctggaggcagaggttgcagtaagccgagatcgcgccacagcactccagtctgggcgacaaagcgagactccgtctcaaaaaacaaaaacaaaaacaaaaaacaaacaaaaaaccataaattcacagttcagtggcaattttaaatggaaagacacgccttattcactatgatgcttttattgctaattcattcagtgaagaggaattatgcaaggtttaaaatggcttgcctgtcctggtatatccaaaactcttaattcagaagattcatctatttctccaagagaagaagctcgtggtggggctggaggaggttcaggctcaagatcaaagtccaatttggttactgtagaatcgcttatagaagataaagtaactcaccaaaacagtaatagaaagtctgtattttaaacagctttaaaattaaagcaaacaatttactttttaagtaaacagaacactactttcaaaatactacttgggaaaaaagcaagactcagtacacctgctataatcagtacgtaagaatgtcccaataactttgtataagagatgcttaaaatctcagacacatacctagctggaggtgctagttgagggatgcgtacatcaaccactggcactgtagtaggcacaggagcttgagggctgaaggtgccagaatgatttactgtaggaatagctcttcttactagccttccccaagtggcaatattaatattcatttgaggagctctgagaaatgttttgccttgttgctttgaaaaaattttcttttgtctttgaagttttggtcttctttcaataactggattaaaaaaggtaacctctgcaaataaagtaccctgtggttccaaatagagacacatgccatgccgttggttgtctaaaaaatcttctaacctcagaaaattttacagcacacagagaccgccaatcacgccaataaactgaaatttccagttcacgtgacctgtccagttccagtgtaaacttctggtcccatgactgattggaaatgggtttccagctagtttggccaaccacagtattatcgagcttcaaaacagcacagacatcattggacaagtcatcggtttttagaagatttcgactacttccgcttttacttttactcgttctgctcatgaaagatgatctggtttcacttggactccaaccaggcagtgcaactgatgttgcttttgaccgtccagggacattctctaggatatcttggcagcccataagacgaacttccaaagtacctgttagtgctgctggtttggatagtgtactatattgattttgcgtagatatcatactttgacgtggacttagtgttggtgatgcagcaacaagtgaaagttcttcaataataatcctgcttttgggatgattcttggggacttcgtttaatctttgctctaatgaatactttaaaaggtccaacttctgacttgattcattaaatcttgcttgagcttctgaaagtgcttttctgtctgttacttttcctgagccaagtaatttcattacattctttgcaccttctgctactgcaaactctatcctaaaatgatgccttaattcttccatccgaagttcaagaggacttatcacaggttttgcattatcaaaagccaattcattagtctggactgcctgaagaatctgcattcgtatgacttctatttttgtcttgctgtcctggagcagttgctgagctgtaccatggagtttccgatcctttgaagatccatttgaatacatctgtatcatattctctgcaccttgttttactttaagttctatatccaattgtttttgtagggccttcaatctattggtgctagtagaacaacgagggtcattatttggagtatctggagtccttgggcaatctgtaatatcttctggatctgatacaacaatatgtgcatttaattcctgcagcttgtgatgtagttcttctaatttttatttgattttttcaaaatgttgtctacataagccaaactttttttatctgttgtgactttcctcagattttcagctccttctttgattttcagttctttccttatttctctcttaattcgatccttgatatcatccaatttctgctgcaccattgtatctgaaaagtctaatttttgaacagcactcacattctcagaaaacggaagacttcgggaatccccctgcagttccgtgagcagaatctccccccgttcggggttggacgccattgcgctccggtatggactccgcacctggac

SEQ ID NO: 414 - DNA, 888 bp, Homo sapiens
attttggcttcagtttcatgtaaacgttttatatatacaaaacagatatgaagcaaaacaaagtaatacaacacatttccaaaatgtaaaaatgaaaactgaacaattaaactagctgtataaatgttggcatgaacaaatagagaaaaattatatcgaaatgattttgtggaaaaagtattctgattatgtacccaaaaaggaaagaaagagagagacaagcaaggcaggaaggaggaaaacaaggaaggagaatggatgggggggggsagcgggsgaggsgggggggvaaggatggatggagggagggagtcagggagggagagaaaaataaaaacaagcaaagacgtaagayaagagagagagaataaaagggagggcagagggagaccatgttcaactgcatacctgggcctagtgttttagtggtcattatagtattgcttatgttgttatagacataaggaataagcaccactctcagctgtgatctctggaccatgactggatacatgattcagtataaatacccttcccatttgctgtccaaaatatctcgcttcacagctggaccctagttgtacctgtgtgtcataggaagcagagtgagtgggcctcccccatgtcctaggagagctgagagaaccttgctctcagccaggctgcttagctgaggcctggagatggcagcttggtcttcaggaaagttgtgggggaggggtggggaacagggtgcggctgctgccaggacagtgtgatattaggagggagatcaggagtyaagctgtctttctcttgttcagaatacagtaaatttggtgacaggaaatgagagggggcggctctatcctgtgtaccagaggcagccacaaggcagattttcagtgt

SEQ ID NO: 415 - DNA, 5929 bp, Homo sapiens
atcggcggcggcaggactgggggagtcagaggtctggcagcgctgtctgcgcagacctaccggacgctacctcccaaccccccgtcttcctcctgcctcctcctcctcccgtcacctcctgacccgccggagctccgagcaactgccggcctccgcccccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaaaaaaaaaaagattggtaaactagaaatatcaactataattgtcaggaaattaacctaaaggcttttgtttctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataataaatcgttacgtctcaatagtggtaatagtggtaatggtttattattagctgtttcaccaattgaactacattcttttggagacattcctttcttttttgatgttgatttgcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttc

SEQ ID NO: 416 - DNA, 1426 bp, Homo sapiens
gtcactggaatgatggatcttaggggcccaggggtagcagagtgggaaaggctgcacccatgctctggagggtaggaggattgttatatgggactcacagcacaaacacgtgtggatgcagtgattgtcaaatgatccaagggcatgtcttgttgctcctattttttttttcctgtctgaatggaaaacagcaatttcctccattcctggttattgcagatgatctgataatttaacctgagagccgttatttcattttattttattttaaaactcaaaagaagtatactgttctcatcttaaacagtgagatgtctggtctttaatattactctttcttaacatacaataagctagcagtgtggtgatgacatgtagatacctcctaatgtgccataaaatcaaggcatgcattttaaaatgtttcgtgcccagaaatccaaacttttatagttgttgagcagccatcttcatatggtctgttctgaattcttaaaacctgcaggagctcatcagcctaacctggccccttccagctcatccccatgtcctattttgctatatttgagcataacaagattttatctcttcctttttaaaaattaattacctaataaatatgatcaaaaattgttaaataattttttaattacctaataaatgtgaccacaaatattaaataaaattatatagattaaaatgctgacgttctcttctcccccatcctattcccttgcctagaaggaacttctgtataaaaaacttgctgggtatccttttagaaattttatggtatattaatcttgtatacatatacaactgtgggtacctatacaactatgtatctctttcttttaatacacttcaaattcttgctatataccataatatacttaaccatatctccatgatggacatttaaattgtttggagtttttggctattacaagcaatattgcagtaaacctgtttgtataatttttctgcacatactcctgtagaattactagaagtgccatttctgaataaaaaattgactagtattaccaagttaccctataaaatgcctaatcagtttatattctaacagggtatgaaagtgcccatttctagccaacattagataccctcagtctcatacttaagtattttttttcccctaatcagttagatgaaaggtgatttttttaactaacaattttctgattgaattttctgattgttccgtagcatttttttttcctaaggtattttagccatccttatttcttcttttcagaatggtatattcctgttgtatatccattttgatatcttaatgatttataaccctttataaaaatagaatgagtgctaatcctttgttatgtgtactacaaatacatatttttttccagtctgaaaaaaaaaaaaaaaaaaaaaaaaa

SEQ ID NO: 417 - DNA, 2358 bp, Homo sapiens
atgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagacactgaataaacgcaggaagacgtctgtcttcattctcctcgtgggtcgctggtccagaaacaccttgatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtgaggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggataccaggtcctgtggtggtgtgggcagggcgcgctctctcctctgagcagcctggggctgcgtgtgtgaacagaaacaggcctgccgatttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttagggccgggcgcggtggctcacgcctgtaatcccagcactgtgggaggcggaggcgggaggatcatgaggtcaggagatcgagaccgtcctggccgacatggtgaaaccccatctctact

SEQ ID NO: 418 - DNA, 4244 bp, Homo sapiens
tttaaactgtgctttctaagcacagtcaggtagcaaaagtaataaaaaggatggttgaacaagttttcttgtatgttccaggatatgtttgggacttttctttgtttattatatgagttgttccctttgaaattaaagctattttgtaggttttgtgggacataatttgataagtagagttaattaaatttcttctggaagagatctaaattcttattcttagtgagagactgtagttaaaggaaggcttttagaacttgggttcaaggaagatggagatgcgtcggaagctctttggcgggggtgaggaagttcagaaagtgtgcattttccttctggcatttaggtcttgtccgtgtgatttggtggtgcttgggtcataagcctgattaaaattcagggacatgtaccacggcggccaaagcggaattaatttttttatatggggactggagcgctgaaaagttgttcctgaccaggctctaatgagaaattcctctctccccaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaaaaaaaaaaaaaaaaaaaaaaaaaaaaaaaaaaaaaaaaaaaaaaaaa

SEQ ID NO: 419 - DNA, 7999 bp, Homo sapiens
cagtgatgagttctagaaggaaagaaaaggctgatgtgacagtgaggaagggatgagtggagacttctctgagacttcagtgattcctcttcctctgagctgagccaagctgagaagctgagaagagtaagatagggccgggaactcaggtccgttagtccgtcctccgaggtggggcgggccagcagaatggatttccgatctactctgtgagagcctcgcccaagaaagcccagagccacttccaagatccgcgctcccacggcgatgagaagcgttttcccccgggactgcttggcttaggactggggacccactggctttggagtaagccctggcacgggcctcgagggaagaaagaactcccgcgctccccacactccacagggcctgcgatcatctcagatgttccggttccacgtgcagaaaccccgccggtccgaggccccggttctaaaacggccctaagagtcaaggcttccacagctcgcctctgagggtggcaaagaggccgcgggggcggtgcctcgcgagacccaaacaagcccacgtggcaggggcggggctccgcgaaggcgtcacggcgcgctcgtgcgctgctgaggtcacgcgccggcagtacccttgcccgggggccgtaaagcgcggaaggtcgcggtctcggcttccccggaactttttgctcgcttcgccccgcccccttcccatccccgaaccccgctttccggcccgcggcgaccccaggcaactgttgtggctgccgcattgctcccgccgggctgtagctgagcgcggagcccgtggggaccggtgagatggaactgttttcccgcgttgagacgtgcggtccgcttgtgcttttagaactaaagactgctgcagagtccggaggaagaagtcacctagaaaaatctgggacagggcatttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctc

SEQ ID NO: 420 - DNA, 4087 bp, Homo sapiens
actcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataaaaaaaaaaaaaaaaaaaaaaaaaaaaaaaa

SEQ ID NO: 421 - DNA, 1876 bp, Homo sapiens
caaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacttcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagttaaaaaaaaaaaaaaaaaaaaaaaaaaaaaaa

SEQ ID NO: 422 - DNA, 2787 bp, Homo sapiens
agaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggaggggaaaaaaaaaaaaaaaaa

SEQ ID NO: 423 - DNA, 581 bp, Homo sapiens
tcttttttgaacaggtccaatgatttcagatcttctggaaaaggctttttgtcatttgcttctatttccacaacacttacatcagtgaaattgccatctgaatacatttgatcttttgaattaaaattgtgccttggaggagtgtgaggtgaccactgggcaatatgactctttgaaggatctggaacattaggccagatgtgttttttaattaggtctcgcttattaaagcagaacagcactcccagaagagttgtcaataggaatgctaatcaaacaggcacgactatggcttcaatttctccttgagcaaactttggggtagtaaaagtgaattctggaccatccttcccaccttcatctgtgtatgctgccattcgtaccatgtacaatgtgtcactagtcaaagaggacaatgtatattctgtgtgggaagaatccacattcacagcagtttcatttccaatgatggttctataaaatatattataatttctgataaactcattctgaacatcaacatgaagttgcatccactctaagacagcttctgctttccctacatttattgaccgaacaga

SEQ ID NO: 424 - DNA, 2040 bp, Homo sapiens
attgtttaagccaagaaagctctttggtttgcttttattctaggcttaatgtttatgtaacctaaacattccccaatcttgtttcctacaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaaatgactaaaaatagtgttttgtcaaaaaaaaaaaaaaaaaa

SEQ ID NO: 425 - DNA, 4326 bp, Homo sapiens
gcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctcgttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcacccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaaggcaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcgggagccctggatgtcccccacgccgaactcgttccgacagagtgccaggctgtcaccgctcctatgtcctcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccatgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagacggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtctagtgtcagcagtgggatacctgcgcttgaaggacatcatccaccgtgacatcaaggatgagaacatcgtgatcgctgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtgtcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaattttttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtg

SEQ ID NO: 426 - DNA, 1280 bp, Homo sapiens
atgccccaactttccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccagggtcacacccgtcacacatcccatcagatgtcaactccaaacaaggcatgtccagacatcctccagctcctgatatccctactttctatcccttgtctccgggtggtgttggacagatcaccccacctcttggttggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgtgctctgcttttctcctcccccatcccttcctcattccttcaaccccttcccctaaccaccaccaccaccaccttttaggaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctga

SEQ ID NO: 427 - DNA, 2127 bp, Homo sapiens
atttttcatgtcacataattttggagtatgtcatggacatttgaatattttgttacaaaactggatgctgttaaaatcctctggaaaatatttttggttttttggtttcactttagcgggcagttaacctggttaggttcagactgcctctgtgggctgtggatccagtttgaacttacttttcaaaaccttcgtattgctgttcaggtcccaggtgtgccatccatgccattgtgcagttctcagcgcctttcctctgccgccttgggtcagttcacacatgggcatgttggtggtaaacttgagattgtatacacaaatttagaggacgtttcttctctccgtgacttcccttgtacacaagctcccaagagtttcttttcgtggttctttggtgagaaaactggaattttagcttctttgtgcttttcatacgttttctgtagaggggctcatttcctgaacaaaatggagagagagaaaagttagagaaaaaaataaaatgaattccctcttccatactcttccgatcatcgtctttttcctagttcttttgtcagaagaactctcttttagagtttaggagacagctaccagccacaggtgtgcagactcaggattggggcttgctttgaggcagagctgagagagaagaaaaattaccagatatccacccctccccattgtccctctcccattcatcatcttttctagttctctagccagaaggagtttctcttggaacttttctctgtcttcactcactgcacagttaatgagatttgggctgtcctcaagtctaagctgacatatgtgggagaaaaaaaccaggaaactcactactgttttgagttttgatttctctcgccagtctgcttgcttcaaattacttttcagagtccttgtatatttgctttatgtattctttccaggatttttagtaataatcaatggacaagatagggtggagtgtgctttctccatcttagctagaactgggaccccgtcccccactcgtaaaatataaataatgacttagcatggcacattaggtgggcattagagacaccagggaagcgattacaaatataaatgcccaggttgtatctccagataattaaaaatctttcaggagtaggatccagaaaactatatttaaaagttctctaggttcttgatatactatgtaggttgtggtctgaggaccactacatggggatcatttggaaacttgttagaaatgtagactcaggttccattccagacctgctgaattggaacaagatccccagatggtgcctacgcacagtaaaatttgagcagcactgccctagcatgattctagtgtgcagtcaatgttgaggaccactgtcttagaggattgcgtaaaagcaaatgacgtgtatataaatttagattgtaatattctctgagtataaactcattaggtgcaagctgagctcaccctccatgttttctgtgttcctggttaaagtaagttacctttgatgaaaaccacaggttcatctttgacttcaaatcagatttgttgctattgaagctaattggatcccagctcagctttgtggcttggattcacaccatataaaatcttcaacagacattcattcctttgttcagaacacacaaccttctaacgtgaacctccaattttctaaattcattctttttctacttcacctgaaaccacagatccatggcacttagtttctctgtaacagcagctctaccatggtgtccagaaattttagcccctactatcaagaacaaaacatccttgtacatgtttatacatctttttgagtaggagttttccaccagttgcagggattccctgagtctagagtaatgccacaatgctgctcccttttactcctttctaagcatttctgtcagggagaagacttagattcagttgttcactttaacattttccttagatactctcttagaaaagttgtattctgcgcacttctgttatgaagggagtaagggattgctgagatttgttaagttaccaaactagtcttgatagatgtataattattacatatccaccatcacttcatttagctgggcaacaagggcaaaactctgtctcaaggg

SEQ ID NO: 428 - DNA, 488 bp, Homo sapiens
cacagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcac

SEQ ID NO: 429 - DNA, 3336 bp, Homo sapiens
gcagcgcgcggtcccggggtcccggaggggagtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacttaagaaagggcatccagggaagaaacctttaaaatgtaatgactgtggtaaaacctttagtcgaagcttctctcttaaacttcatcagaacattcatacgggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatggtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaaaaaaaaaaaa

SEQ ID NO: 430 - DNA, 1869 bp, Homo sapiens
ggagtttgagtgagagatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaaaaaaaaaaaa

SEQ ID NO: 431 - DNA, 2038 bp, Homo sapiens
cgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcggaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagtttcatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagccttt

SEQ ID NO: 432 - DNA, 412 bp, Homo sapiens
  misc_feature (308)..(308): n is a, c, g, or t
  misc_feature (331)..(331): n is a, c, g, or t
  misc_feature (351)..(351): n is a, c, g, or t
  misc_feature (371)..(371): n is a, c, g, or t
  misc_feature (391)..(391): n is a, c, g, or t
ctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagccaagcagtgccagaggccttcagaaagggattagggtagatgatttgcaactgaaacacaatcttctttctttgccagggtattttggggggttttgccccaaaatataccctggggcatagcattacttgcagtcttnggatgtcttacccccaaactttnccacaccattcctttcggancccacagctggcacctttantttaatttaatttttggctnccagctgggggggggggacag

SEQ ID NO: 433 - DNA, 1303 bp, Homo sapiens
gggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaaaaaaaaaaaaaaaaaaa

SEQ ID NO: 434 - DNA, 3807 bp, Homo sapiens
cgcagccgcggaggagcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaacgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattaaaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcg

SEQ ID NO: 435 - DNA, 7757 bp, Homo sapiens
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 436 - DNA, 1935 bp, Homo sapiens
cttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaaaaaaaaaaaaaaaaaa

SEQ ID NO: 437 - DNA, 968 bp, Homo sapiens
cacgcgtgcggctggactgttggtggaaggctggcttgttagcccacgttgctatacatgctgccaatggatttaagacatagataatgttgaaatgttgagtggaattatttccctcctaaaacatttatttacagtactcctctctacccctaaggttgggctcatgcctcagaggagtgagttttttttgatttcctattgagtcactatggtcttagctattatataggaggtggaataccaagggtcgattgcctatgcatattttcgcaaacttgggtttctatattagtcacgttccagagctatggactagattaagtgatacctgtgctgatagacataatagtaccatgtataagatgtgaacgtatctgtagtcactctcccctccgatacccctgtccttatgaccatggctttcaagggtactcttgacatctgtttaagagcaagtagacctgaaacgtttactacctcattatggatgccaccacaaatgctgatggccatgcaggggccagagacctatataacagacccgtgggggctggtacaagggtgtaacagccttggcaaagaagtccggctgtggcagagcgttgagagcagtgggcttatggccggcggcaatgaaggcgatgatgatgacacagggtatcacgaatgggcgaagagccatgtgggccagcagataactttggacagaagagcttccagcggtatgtgacagacactggttgactaccccgatacggggacatggggccacaaataacgaaccccacaaaggaacgggtgtacgattgcgggaataccattaagacactcgtagatgagctataatcgtattacacacgcacacccgtgaaaatgcctaaggggctagtgtgacaaagataacagctagtgcacactatatgtggcacagtaataaacatatgcgcgagttcaattcgattacg

SEQ ID NO: 438 - DNA, 2279 bp, Homo sapiens
ttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaaaaaaaaaaaaaaaaaaaaaaaaaaaaaaaaaaaaaaaaaaaaaaaa

SEQ ID NO: 439 - DNA, 447 bp, Homo sapiens
tgggtacgcgtaagcttgggcccctcgagggatactctagagcggccgcccgttttttttttttttagtagaaacgggtttttgccatgttggccaggctggtcttgagctcctgacctcaggtgatctgcccacctcggcctcccaaagtgcttgggattacaggcatgtgtcactgtgcctggcatttttttttttaatagagacaaaggtcttgctattttggccagactggtctcaaactcctgagctgaaatgatccccccgctttggcttctccaagtgctgggattacaggcacaagctgccaggtctgaccacctttttttattgttgttgctattttaaataacgctattgacaactgacattgtttaagacagattcctcatggtaaaactgctgagaagaacatgaatatgaacaatattaagagaatccccaggt

SEQ ID NO: 440 - DNA, 708 bp, Homo sapiens
  misc_feature (498)..(498): n is a, c, g, or t
catcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttgggttaatcaatcagaattagagcatgggaggtcatcactttgacctaaattatttactgcagataacctctccttcatgacagcctncaccccacaacccaaagggtttaagaaatagaactataactggaaagatgtttatttaggcattgggatattttactttagaagcctgataatgttctggattcatactggtacatcaggactcttggagtgggttatcactgacttagtgcgttactactgtggaatactgatatcagacttgaagaatgtgatgccatgtgatcctgc

SEQ ID NO: 441 - DNA, 7732 bp, Homo sapiens
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccaccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccatgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaaa

SEQ ID NO: 442 - DNA, 1883 bp, Homo sapiens
gacatcacggacagggcgacttctatgtagatgaggcagcgcagaggctgctgcttcgccacttgctgcttcaccacgaaggagttcccgtgccctgggagcgggttcaggaccgctgatcggaagacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactgtgttgcccatgctggtcttgaactcctggcttcaatcactcctcccacctcggcctcccaaattgctgggattacaggcataagccactgtgcctggctctattaaaatttaattaaaatttttaaaaagtgaaaattcaggctgggtgtggtggctcacacccagcttgctggctaacacggtgagacccccatctctactaaaaatacaacaaattacccggacatggtggcgggcgcctgtattcccagctacttgggaggctgaggcaggagaatggcgtgaacccgggaggcggagcttgcagtgagtggagattgcgccactgcactccagcctgggggacagagcgagactccgtctcaaaaaaaaaaaaaaaaaaaaaaa

SEQ ID NO: 443 - DNA, 1982 bp, Homo sapiens
gcggacgcgtgggctggaaacaacccaattgtctatcaacagtgactggaaggacaaattgtgctatgtccacacattagaataccagttggcagtcaaaaaggaagagctgatctgtgcagcaatttgagtctcagtaatttcatgtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgagacacatttacagctacatattccctctgagcattgccctggctgccttccataagtgtggagtgccactccagctttcttaggttgccatctgcatgacacatctttctccatccttttactgtcaatctaatggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagtccagctgaactctggctctcaaagcaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaaagcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagttgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgttaaaaaaaaaaaaaaaaa

SEQ ID NO: 444 - DNA, 1010 bp, Homo sapiens
ggctggtgaattaccagatctccgtcaagtgcagtaaccagttcaagttggaaggtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtgtgtcagtttcttggtcgggaatgaaaatagtgccaacctgtgataccttcactctaattttactttctgaggaagttttctgtaatagttatttggtgataattattaatactgatgtgaatttcttcggagtaagaaatcctcagaggaaattacccagtatattcaaagctacaagggatttgttgacataacggtctgttttcaaggcagtttccggaaacagtgaccctgagaaggcttcctcctgagtatgcataaacattcacagcttgcatgcgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggga

SEQ ID NO: 445 - DNA, 10238 bp, Homo sapiens
ggattcctccagtccctccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatattttgattttcttaatgatttcaaaatgtaaagtctattttatacagatcagaccaaaaagaagaaaaaaaaaaaacaggcaagaggttaggtttggcccatgggccatagtttgctgacttcagcatagagtcgtgggttatttacaagtgacatacttttcctgggttatctgggtatgttgactccatgccacttgcataaagcagcaatggatattagtattatggatgtccagtaagttattccacaaagaccatgcctaaggtggcatcagccctgggctccacagctgcgtggcatcaaagctttctcttaactctcttacctctaggcaaactgagacctcaccatcctctcccctgcttcccacgacagtcctttgcccttgccatgctcagggttggaatcaagttgttctattctcaacagaccaaaatgtttagttaaggcaaagtatcttggaaacaattgtgattaattacagtcttgtactcttgacaaagctgtgcagatggcaataagttcataccagcaatcctggagtcccataataaatacgtacatgtggaacatcgtgcacataatttcaacagttcgcagatctgtagttatgaagccagggtttggtggtatttgctctctcttggtgcatttgataaggatccactgaggcctgaatgtggaagatgatgggcagcgagaggagcgtcagaagaccccagtcaagacgtgttcgccatcagaggttacaggccgcacagcctgatgagcttcaagcctggcagggtaaatagtttttgggttttttgttttttttttattcttccactatcatgttttttgaggattttgcatatttcttgttgccataatgctgtgctattttaccctgattttcagtgatacaatatgggtgacaatactggcccctccataaatctgaagagtaagaagtagtgaaaataaggcttaggatatgaaatggcgttgtcacttgaatcaaggccactttttgtcctacttgagcatctcaagttgggatgcatcttctgatggcacttccggaactggctgtggtttttttgggtgtaccgagagtgccagtgactgtgcttcttacaattcctggcatcttgagtaggtgaaacactgtatcagactgggtgatgggcacattgtcatttcaccaagttcctggaactgttagaattgcttgtgtatggggatcctatgttagttcccctggatacattgttttatcagtcggaattcttaaataaagacatacttcccttcaaaaaaaaaaaaaaaaaa

SEQ ID NO: 446 - DNA, 1756 bp, Homo sapiens
gcttgggggcggaaaagccgtggcgcccccttgcgtggcgcgtcggtctcagagtcgcgtgacttcaaccccctcttcgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtggagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatggaaaaaaaaaaaaaaaaaaa

SEQ ID NO: 447 - DNA, 6091 bp, Homo sapiens
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaaa

SEQ ID NO: 448 - DNA, 9580 bp, Homo sapiens
cttggtcacatggtggcacggccgctgcgtcagtcacagccctggctgcaggagtccagctgccgtcgccgccgccagcggacggggcggggatcctggtgccaggtcttcgttaacccgcccccgccgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcgtctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcctatacaccattagactctttacaagcaaccaacgaaccaattgcagtggttgcagttgtcacagtagtcttgcctgggccagactgggctgggctgtgggaagcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgtattaaagttactgaacactgta

SEQ ID NO: 449 - DNA, 4134 bp, Homo sapiens
cttcaaagttccccgcatgaaaattacttaaacgttgcacacaacgtttcagaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtatatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaatcaaagatgctacatggatcgttaaagaaattcctgtggcccaaaaggacagtacaggaacttatacgtgtgttgcaaggaataaattagggatggcaaagaatgaagttcacttacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggagattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagctgtaaataccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctcaaagccaatattccatttctctagaatgtttatcctaagctcttgtttgtcagccctctcatactatgaacatatgggtagagagtatattttc

SEQ ID NO: 450 - DNA, 613 bp, Homo sapiens
gtgaatcggccgagggaagattctgccgattccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttacttcatcatacattcccacaaaacaatg

SEQ ID NO: 451 - DNA, 555 bp, Homo sapiens
caacttataagtaatttattatgatattatagacaaatgcaaaattactgatatatagggaggttcattgcacagaaatttggtgctaacataaatatctatgagtgagaaatgcttaaaacatttaattatattttatctacaaaacattcatgtcgtcattcaacaaatgacacagatgtgtatgtactactgaaaaagaaaaaggccattgaataagggctgttaaatgaaagaggtaatttgcagaaaaatgtgttacaatatggccacacacgtggatccttccccataatggcttgtgtgtttgtgtgcatctatccactaaaagaatgcatgtagttcacttaatagaggaaaactatagggacagaattggaagagaggagggcatttaatttatatattatttaaatatgctttgaatttttgaaaaaaaatcatgcagtttctttttaatatagtctgtatttttcagtttaccgtgtggcaaatgaaaattataaatgtatatttatgggagcactgagcaattccaccattttgagcatcttg

SEQ ID NO: 452 - DNA, 3108 bp, Homo sapiens
gctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtaaaaaaaaaaaaaaaaaaaaaaaaa

SEQ ID NO: 453 - DNA, 1720 bp, Homo sapiens
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggcccggcatcatcccttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaaa

SEQ ID NO: 454 - DNA, 5360 bp, Homo sapiens
gggagagaggagttgggctgtgccggaggccgaggaccgagagggctcaggtgacccctggaaagcctgggtggctggaaaggagcctagcgcctgcatgaaaggaagaacctgctgggaagtacctgagctcgagctgtgggttccgccgcccttcccctgcgtggtggcttggtggccgcgtctgcgcctcagccctgagaatccggatggcggtgaggtggacttgggcaggcaagagctgcctgctgctggcgtttttaacagtggcctatatcttcgtggagctcttggtctctacttttcatgcctccgcaggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccacctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaaaaaaaaaaaaaaa

SEQ ID NO: 455 - DNA, 372 bp, Homo sapiens
atgctcaggctgctcttggctctcaacttattcccttcaattcaagtaacaggaaacaagattttggtgaagcagtcgcccatgcttgtagcgtacgacaatgcggtcaaccttagctggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 456 - DNA, 2914 bp, Homo sapiens
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcgtcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactgaaaacaaaataactaatttagaaatatatgagtggtaccatagaaacattaccagaaatcaggcagaacatctattgagacaagagtctaaagaaggtgcatttattgtcagagattcaagacatttaggatcctacacaatttccgtatttatgggagctagaagaagtacggaggctgccataaaacattatcagataaaaaagaatgactcaggacagtggtatgtggctgaaagacacgcctttcaatcaatccctgagttaatctggtatcaccagcacaatgcagccggtctcatgactcgtctccgatatccagttgggctgatgggcagttgtttaccagccacagctgggtttagctacgaaaagtgggagatagatccatctgagttggcttttataaaggagattggaagcggtcagtttggagtggtccatttaggtgaatggcggtcacatatccaggtagctatcaaggccatcaatgaaggctccatgtctgaagaggatttcattgaagaggccaaagtgatgatgaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgacattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcactaatgtaatcaccatgaagtctgacaacaggagcccattatttgcgtactgtcccaccctgtatcatggttctctgggaacaagctttatgattctcattagagtttatttgttgattgtcagtagttgcgacttttaaattatatttcccccactcaaagaatggtatctttatatatcaatgacattcaataaatgtgtattatttctaatgagaa

SEQ ID NO: 457 - DNA, 5242 bp, Homo sapiens
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 458 - DNA, 503 bp, Homo sapiens
tttcaagattacattattttattttaaaactaagctgggtggccaacccagggacaccgtgctctgctaaatgatgactccagctacatttcccgaggccaagagatgagaagctgctggctccaagctccgctgcaggctgccctggctgagcgggagctaggcaccgcggagcgctgcctggtgctctgaagccatgccccagtgcctccctgggagttctgctgtggagtctgtgtggagggtgactctggagagatgtttgtgtccaggtggctgcctgtggtctggctaagtaaaggggtgagtattcttggtgtcactgtccaaagcaaagttgtgaccatgggacacagactaggtgaggctctgtgtccaggtgatgctgtccagtgagagggggttgcagtcagagtgaggctgaccggaggcctctgtccagttggtgccctgtgctaatattggatttgttctccacagtggtcatggcaggggcagatgcc

SEQ ID NO: 459 - DNA, 5362 bp, Homo sapiens
gctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcaccc

SEQ ID NO: 460 - DNA, 826 bp, Homo sapiens
  misc_feature (458)..(458): n is a, c, g, or t
aggtacaagggattcccttaattagatgacacatcaagacagatctgattcccaccacttggagcagtttgaatcgatgaccccaggttcaggcagaagttctgcagcctctgaaatcttcagggtctggaccctgagatgacgttaacaggacccctggccagtttccatgagatctgggtctctgtcactttcagggggtaggctcctggaggcggccaggtgtcctgtgcctgctaggccacctgtctctgagattcctgttgctgtacctgtgtgctctgcagggtgctgcggggggcctgtgggggccctggggttgggaggctgagagcagtggagagacctggggatgtaggtgccggctccgcagggctagtaagcagttctgtggggaagcggggcagcaaatggtatgagggtgagtcctggggagctggggacccggggcagcctanagcactgtcatcggaaggaacggggctggggcagcggccttctccggtaagtaccgaatgcatttctttttcctcctaggaatagtgaagagaggtatctgtggtggattcttggtgcttttccctcgaccgcctctactttctcccctagttgtcccgcgctggacagcctggtatagctgcatgtgcagctgcctgtccttgcaggccagctatagtacttggcctgctcttcttgcgaccgcgcgtgcccactgcgggcccagaatctggttggtggccacgcctctccttaagtgtgacctctgaatgacccttggtctcatctacttctgtacaacattaaagcattgaggggcttcttgatg

SEQ ID NO: 461 - DNA, 1640 bp, Homo sapiens
cccggacccaggtgctgccagggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaac

SEQ ID NO: 462 - DNA, 2414 bp, Homo sapiens
ggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaaggtgggtcaggtctgctcgtggggaaggtgggaggactgcgcacggccgggagccgaagcagccatggcggtgggtggcagatggagacagaaccctcacgctttgggcaaacttgccctctttctgcttctaagtagggcttgctgtgctttcttgctctcaatgcaggtgctcctcgagagtgagaaatggcagtctgcctgcctcggggacactagtgacagtataaagggcaaaggaaaaccgagtatctggccttcacgtaaatcctggccacattcaccaaccaaagggggacagtgattttcaaaaccagctcccatgtgctgagaacaccccagctgcatttcttttgcaagattcctttccactccaaccagaagtgaatatttgagacaaacggcctattggctattttcccatgccagttttggaagtggggaaaactatggtggaaatttgtgggcttggggacagaaatgccactcaccaacccagggcaaagaacacaaaccctccaggcctcagtttcttcacctgtaaaatggggtgaagctgtgatgtgcctactcccaaggacacgacacacagtagggacctgccctgtacatgctagttcaacagaaaggaatggcctttcaccttctcctggtggcaggcaagcagatgtcctctgcggagataccgccagctccccaggacgcagactgactcctgtttgctcgctggaccaaccccaggcagaaggtggaaggtgggaacagaggtttagctgcaggaca

SEQ ID NO: 463 - DNA, 567 bp, Homo sapiens
  misc_feature (528)..(528): n is a, c, g, or t
  misc_feature (559)..(559): n is a, c, g, or t
ggtaaacccactccatcgtcatacatttctctgcaaatcttgtacacggatgcctcatccttaggaaaataaggtctgatagtataaactttggaggtaggagtcagtggaggtggctgaaaaaaagagatcatttgccccatcaattggcagcaaacgctgtgggaagaaaaaaaaggagatggattagtttggggaaggtatccatttttttaaatgggtgtgcactgcagattaccaacttatattaactggctactgcaggcagacctaaagaagaggggtgtactatgctttactaatagaaatacctctttgctgggggaggggagtgcttctgaatagaaattacccactctgagttacagctttagtggcatattaatggggatttaaatttacagtaaaaacaaaaacaaaaacaaaaacaaacctattccaattatgacaaatctatttttttttaaaacctatcttagatagaccatcttcctacgataagatggcagaacagaatgtcaggaaganaaggttggtctgaaaaagggtatctggccangaaacctt

SEQ ID NO: 464 - DNA, 4629 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 465 - DNA, 615 bp, Homo sapiens
ttttgatcaattactttagtcctagattatttccaatagctaagttatctcatatctgctacgggacacatctttcctgtggtgctaccatgcctcagtggagatatttaattctctaagcacacttatcatttttgttcactcttagatgtctaaataaccatatgacacaataattactcattttgtttgtagtaatagaaccaaaactcaaaactaatttaaataagtcgtcttcaaaattctgtaaaaatatgcctctcatgccaacatagtatctcatgggaattgaaaaaaatgttatgtttattttctactagactgttaagcatctccagggaagggccatactcatctttttaactgtcagcacttatctcttatgagtacattccatgaccaaatttcacataaggcagtgtactatgccctgcaagttacaaggagcaccttttgttgttgttgttttttttttaaatgtcaatgattggtgataatccacattctaaacttgtcccaggtacattatataggctaaactttcttttgctgtgaagggactcttaaaaattcttttgtagggaagatagtttggccagaaaagaacaagctagt

SEQ ID NO: 466 - DNA, 2872 bp, Homo sapiens
tctcacctccggacgtgagaattacaggcttggatctcaaaccgccgcggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaggccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattgg

SEQ ID NO: 467 - DNA, 20612 bp, Homo sapiens
gatcacaggttgtttgctcccagaaccagagtcttactactcagctccccttggcccaggggcctacccaacagagcaggcttgctggagtcccagacctccaggcagagggtcgtgggtgggctgtgggtggagcatgtgtggaagctgggtctgctgggaaagtggaaggccagccccggcttcctctgcccctgtgtaagtgctgggcacgcccttgcagtagtgggttcccccgcacaggctgacgggctgtccctctccccagcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggtgagtcctgggcgagtttcccccatcccctcattcccacgtttctgcccagcccaagctcacctctcctaacacaggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcaggtgagctcttgggctggggcaggagcagagggaaggcttgcagaggtgggaagggcctcggggtcttggggcaggtgcgtgctccgtggccccccctggagccaccgttcttcctgcagcgagaacgggccagagcctgacagcagcagcacacggccagagccagagcccagcggggaccccacgggagcaggcagcagtgctgcacccaccatgtggctgggagcccagaacggctggtaggaagggcccggggcaaggtggagggagggtcctgggtgagcccctcgcccatcgccgcttccttccctaggctctatgtgcactcggctgtggccaactggaagaagtgcctgcactccatcaagctgaaggattctgtgctgagcctggtgtgggtgaccccagaccgagggccgggcggcgcgggggaacggggcggagggggctggcacagcctggcccaaaccaggctcaccgcattcctgtttcaggcatgtcaaaggccgtgtgctggtggctctggcggacgggaccctggccatcttccaccgtggtgaaggtggggcctggcagcacggggtgtgtgggtggcagctgatggccctggcattgtttagccaaggggctcccggggttccaggcctctccttagtctggcagtgggtgtctcaacccgatgccctgagcagaggtggggcctggccaggcctgagcaggtgtccggggctccctccagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagaggcgagtgccggccagggccccggggaggggaagaggctcctgctggccagcagctctcccgcatcttccatacggaagtccacgaggccctacgtggggcccatctcccctgtaccacctatgactcaggcttgaacaggcgcaaagcaggcgctggctgggaggtctgaggggactgcaggtggccctggagctgtggcaggtttggggctccccacttcctctcctctccccagccctgttgatgggcagccatgactccacagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggtgaggggccacgccaggtggggtggtggggggctcaaggccagccaccctgaccgctctcccccacaggcactggcaagctgggtttctccttcgtacgcatcacggccctgcttgtcgcgggcagccggctctgggtgggcaccggcaacggagtggtcatctccatccccctgacagagagtgagtggcctgcacccctgcaggggcagtggtgctgccagaggtgtacgtgggttcacggggtggctctgcagggccaccttggagggtgccttgctgcccctacgctgaccgctctcctcttctcccatgctcctcccatgtccccagctgtggtcctgcaccgaggccagctcctggggctccgaggtaagcccagccacctcgtgtcccctcacaggagcctctcccatcctccacctgtatgcgggctcagcgcctctgggttctctccctgcagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccaggtgaggctgggcccctcctgccatccacatcccctgcatgccagtggccgccgcctcccccaggaggccgctgtcctgaatcgcttctgccatcccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggtgagcggggcccagggacagggctgaggttgggcgcggggggagcctggccctcactctgctgctttgcccgcaggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgtagctgcctgttcctgggcccaaaccgaaacgaaaacgaggactttattataaaaaaacgttggaccacgttgggctgggcaccaggacagtgtcctggcacgtttccaggcgagccgcgcaggctcctggagcagctcctcgggcaggaaaccctgtacgccagggattggagaggcctgcgccaccctccatgcaacgtccagacaggtggatgttcagcagcccgtccaaagggatgctccaagcgctgtggggtggggccagaagcccgcccacctgggccctggaggaggctggagtgtgagagcctctgtgacgcgcatctgccgggctactcatacagccagtgcccagcgctgtcctcccagcagaggagctcgtctgcgcggaaccagagagcgatctcgcggcgggcactctccaccgagtcgctgccgtgaatcaggttcctgcgcggaagaggcgcgtgtgagcgtgggaaagagacctccggcacgggtaccacgcaggctgaacagggggaggccggacggggctgggaccgtccccggggcgggccttacttgccaacctcgatgcagaaatccccgcggatggtgccgggcggggcgtcggccgggttcgtggctccgatgagcgcccgcgaggtgcgcaccacgtccagcccctgccaaacctgtgcggaggaacgggcgcggtatcacgcgggggtgggggtcccggagccgcccgcccgcttcccggatactcaccatggccaccaccggcccggaggccatatacttgacaaggcggccgtagaacgggcgttcacgcagctcggcgtagtgctcacgcagcagctcctcggaggcctgcggaagggtcaggccgcctgcgcccgcacccggcacctaggcgtccccaggtccccgctccccttccccccacaccgcgcccccgctcgctcaccgcgcccccacctgcaccagcttcagcgccaccaacttgaagcccttcctctcgaagcgccgcacaatctcgcccaccagccgccgctgcacgccgtccggcttcacggccaggaaggtgcgttcgtgtgcgccggtgcaggctgcggggcaggcggggacgggccgtcaggccggcccagcaccggccacccgcccccggcccgcgccgcgcggctcacccgcggggaagaggttagcgaagatggtcagcaccaggcagatcatgatggcggtgcgggagcgggatccgcggggcggggcggtggcgcccggggcggggcctgcgcttaaagaggcctggtcggggcgctgcggcctccgcggggaggctgcttcacttgcaccccggaacccggcagccgtggggggccggagggcagctgcggaggccaagtctcctccagcagctcggacactaactgtatcccccacaacccgcccaggtggttccacccacgcggcgccctgctccgcaccgcccgaaccccgccccccccgcgcccccccggccagggccacgaccacagcgtcagcccttctctccccggtcctaaagacagagcgcaaagacaccacgaccctgggtacttcttttctctttattccctttcatagcttctgccgggatccaggcagagagagcactaatgggggaaagggagcgagcgcttcccgctttccccagcgtgggccctcggagttgggtgtgggggcagcagggccagaggaaaggcacaggtggcgatttgccccagccctcccccctaagatgcagaccctcagaacacgtcgcggaaggtgagctccctgctccgagaggcagactcgggtgtaacgcaaagacggtttctttcatcaataaggtccccactgcctcacagcccctaaggccacccgctggttctggcattctagacgggggtgcccttggcccttcctttgtcttcctgttttgcagggtaatcccagggttccatgcgtatcctctgcacattcagcatgggctcctcggtgcttgtgtctccatttttctgtcgttctgcgataatcatggcccggaggagaggcgggtacggcacggaggccaggctgtcttccggcgccggcgtgaacgcggtgaaggcctcctcctcgtgcttgggcaccagccgccagtcatggtacatgacgtgttcgatctcccgcgcctcgctctcagtcttccctgatgaagaaaaagaggcgtctgcacacacttgctgtgccgtcggcggtcggcatcgaactgccgggcacccgctctcccgagccttacctttgaaggtcaggatgccccaggccttcccgtggtccaagttctgcaaagccagaaggaagcggggtcagctcgcaaagctctcggcccccgaggtcaggaggtgggagcctcagccacgcaaacctgcagggaggaggggaggcggggagaccaggcggctgcaggggcggggtgcggacggggtgcacgcacctacctgcgccgtgtagtcgggccgcacccgcgtgaggcgccagtagcacggctcgtcgtgctgccacagccaggacttgcgcgtgaccaggcggcccaggccgaagagcgggaggcggccgagcagctgcaagaggcggctctcgcggcgcacgtcggcccaggcccggaccggcagccggcgtccagagaacggccgcgtcaaggtctcgtagtccaccgcgtagagctgggagtcgcgcggcctgttcagttgctcccgcagggcgcgcacgcggcgggccagctccgcgatcagccgcggacgcaccttcttccgcgccatggcgggtccgcgtcctcagcggtccggccggaagtcaccggaagaggccggtgtcccaggctaaagtgttcggtcgcggccggaagcgaggaagaggtcggtccggccatggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtgctgaagcgcctcgcggtgtgcgtggacacaggtgcggcggagggcacgggcgatactcggggtaggaaaggcctttctccgccaggcggcgccctctgtccgactgggcggggcgcgcgtgccgaggggcctggggccgggcccgcctcccagtcgggggtttgtgccgaatggagactccccggtccggccacccgcccaggtagggcgctcgcgagggtggaaggaagcagtgaccgcgctcctctcccccggtcccagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcgtgagtggtcgcgggttcccgagggccagccgcgagttggctgttttgcttccatgatttcagccctggagctgtccctgaggcagctgccctgggccgtgcgcgtctcgcggatgggtaaagcaaggatggagaacgggaagtggaggtgcccaagccgttctgctggtatagagccgagctggctggagaaggttccgtctcgattcaggctgtggtctggattcctgccggccacagagacctggcctgagcttggccttggcaggaaagggaacactgggcttctgtagagcaggcctgtcagggcctgggcttggctggggccacgaaccgctttgctgctggactgcccaggcagggcccctggggcacccggggttgagacaggcagcagcgcgtccccatgtccccacagctgcctcctgaagtgtgggctgcaggtgaacaggaattgctgctgctgctggagcccgaggagtttctgcagggcgtcgccacactgacccaggtgctcgggtggtggcagtagtccctctctaatcaggaggggtgggttcccagccgggaggcgcctgctccgccggtccctgcccctgtagacggggctggagggggcatggggcaggccaggactcctctctgatccaaagccgtagaggtttctagggtgagatggagaaagctcctgggcacctgcggaggctacagctgctcctagaggatcctgagaagtgtcaggaggccggggtccgggcagtaggctgcaggcttcgtcctctgacagcagacagcctggcccctgcctgcggggagcagtgctcaggtgctgtggtgccaggtagcgtggggttaggctagaccccctgccaggtccctgtgtcccaggatcagtgtctctcaagctgctgctttgtgctaggtcaaagctaggctggagtacagaggtggaccaggatgaggggctcaatggaactgacatgtgcccgagcagccactccagggtctccttagcctctttggcctcgtgggaggcacagagctggttttctcagaaggggtaacggaacagaggctcctctcggcaccactggctctttttcaggcttgctgttctgcaaaccagctgtggcctggtggcccatggccataggccgcagcctcctgtgaacaactgtgccacacgttctcatcttcagatctctggcccaacccactgggtgccctggatctcccccgagaccaccgcccggccccacctggctgtcatcgggctggatgcctacctgtggtaccgctcactctcatgcccacagcagggctggctgggacgggggttcaggggaggtgggcacacttctggggttgctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggtgagggcctgtctgagctgggtgagtcaggtggcctgggtcccagtgattgggctgctggctgggtttggttcccagcgtggtacatggggcagctatcagctgtgtgtcccgggtagccttcctctggctcgtgcccatcagcttgcctcctccccaggccctggtactcctgcagctctgggcaaacctggacgtgctactggtggcctcttggcaggagctgagtcggcacgtgtgcgccgttaccaaggctctcgcccagtatcccctcaagtgcgtgatgccaaggctgaaggggggcaggatcacctcaaggtagtggtgcctccccggccttttgggagctgctcacatgcggttctaaaaggcttctctctgtccccaggcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggtgggcccctgcctcctccaagccctccaggtgcagaagccccgtccccaggcgccctctcatgcctttgcctgctcctaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggttggggaggacccccagccacatgtggaccctcagcctgggtgggttctctggctgagcaggtctgacctcagggggagggtgggtggttgcaggggaagttttaggtagctgggagaagaggggcttctggctggcagatggctggcggttcctgtgctgagtcctgaacacgtaggccccaggggagctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacgccatgtgggtgttagacatcaactctacatttattgcagtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcgggtagaatctcttgttctgcagcttggtggctgccacacctggaagggaggggcccagcctgaaccccaggcagggaaggggccagctactgggcgcagcccctcagacctcacgctacagtcacccgggtgggcagctggcacagctgaggcaaggcagggtgcacgcgctggccctgccactccagcctggcctcactgtcccaccccctgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgacgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagagctccatggggctctgccctgcccacccccaggcccgcccgcagtgcagtcccagcaggggctgggccccacgctcacactcgtcttcctctccgcagcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgccccgtcaggccaggcagctgccctcagggtctgccaaggtgggggtcaagggccatgggggcaggtagctctgcctgcaaagcccacaagcatgtcagatcacctgggctgcagacagacaaacacctgagctgttctgaataccttcaggttcctggcctcgctgagcaagtgcagaaatttttaccttcaaggatcagggtttttctgtttgtttgttttttaacacacacatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggcatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaggctgggccacggacccactcaaagtggggactgcaggggccgcaccggtgcccagccagggctccagaacgcttcaggagcccgtacctcaccccaggatctgagcagctcaataaaacccaggtagatcctgtgaaacgccacccagacacccatgactccggaatgcgaatcccagcccctctctccggttccacctcacgaacctggctgccccgcccgcctgtcccgcaggcatctaaaacctccactcgctcctcctctgtcgtccggtttgacaaatggcatctccggcctcccagttcctcatgccagaagcaccgtgaccgctccccgacaccttcccctcacccccggcccgaccgccgcacccgcctgcatcctcctcccgccaccgtctcctgggccgcgcagctcgccttcccctccgctcgctaccgccagggctcctcgtgaaacacaaatcttaaaacctgctcagcgctggccgctgttatggtataaaatgcaaaaggctgcgagggccaggtctgcgcttcccaggccacctgcctggcacctccctcgccagctccggggttcccgcctagccttccagggccgacccctgcgccgggctcgcggctggcaacgcccgctgggccccgggtggggttccagggaggccggggcggatcgcggcgcccggaccgccgaaccctgcccagccccaggcgagcgcgtgtgcagcgggagccgccctccccggcggcagcccggcctggctgttccctcccgcgggcgcgcgggttccggagtcggcggcaccggggaagcctctctcgggcgcggccctccggagaggaacaaaggcggcgccctggccgcgctgctaccgccgcgcccgcaaggtcagcgcgcccgcccagagcccgagacgtcggcccgtgccccgccactcacctgcagcccccgctgcgcgctccgccggcccggccctgacccactttccgccccggagcgagacgtaaacaatccccgccccctgcgcccattggctccggcggcgaggggcgggcacacctgtctcggagcttcgggagagggggcgggagtcgggtgacaaagctattgccgagaggtttcaggaactgtcagtcctaatccaacgttcctattggtcagttcccaagcggttggagacaaagctcgcgcgcacattggacccgggtgggaggtggtaccgcaggccgcgttgaccggaaagtaggtccgtgtcatcgtctgcgccggaacctgcgggaccggatcgagagctcctccggcaagctgattggctgggacagcaggattaggcctgtcaagaagagccacgggcgggcacgcactgcccattggttggaaggcccttcgctctagctgggaggctgacggcccgcgggcgtaagcggactgcagccgcgagctcctggaggcggcgggatggaggcggcggccggtgagtggcgggccagggtgcggagccgctccagggcctcgcttggggccccgccgcgtcccttcccggggcggcctcgctgcgtcgcgcgcctccggtgcgaccatcaccggccggcgtggctgggccgggccagaggccgcggcgcgggcattttctaaacagggtcgtttcccgcgtgctcctgcttcgatgtggaagctccgtgatctcggagggcctgagtcgtggagttgggggagcttttaaagttaactttgttgagcaccgcgttgtaggcgggcgcggtggcgcctgtgggccccgctatcctggaggtcgcggttgcaactgcaccgcagcccgggcaagagcgagaccctgtctctaaataaatcacacgcgcgcagtcatgaaagtaagacggacgccagaatctcacatgcttttaagttctttgtggaagtggcgctctcagtgttcagaaaagtgtaagttgcgcgggacagaattcacaccagtggggacgatccgttcgccagatcagcgccgtgggccctcctgagtagtgggagccgcatttatcttctaagagacctcgagtccgataccaaaaggaaaacattcctcggacagcaaggtcttgcagcacaactctgacagattagaaaccgagtgctggagtcttttgtttttgagacggagtctcgttctgtcgcccaggctggagtgcagtggcgcggtctcggctcactgccagctccgcctcccgggttcacgccattctcctgccgcagcctcccgagtagctgggactacaggcgcccgccaccacgcccggctaattttttgtatttttagtagagacggggtttcaccgtgttagccaggatggtctcgatctcctgacctcgtgatccgcccgtctcagcctcccaaagtgctgggattacaggcgtgagccacggcgcctggcccagtgctggagtcttattccagaggagaagcctggaaaagcctgtccttattatcaggacggatttactacaaagtaaggatattactgagattgatagaagcttttttttttttttgagacagggtcttaactgtcgccaaggctgaagtgcagtggcacgatcataactcactgcagccttgacctcctgggctcaagcgaccctcccacctcagcctcctgagcacctgggaccacaggatgcaccaccccgcttggctacatttttaatgtgtagacatggggtctgaatacgttattgagagtggtgcggaactcctcctggaccgaaatgatccttccactttggcctctcagagtgctgggattactggcgtgagtcactgcacctagtccaagctttcgtttttttgttggggggagacggagactcgctccgttgcccaggctggagtgcagtggcacaatctcgatgacggctcactgcaatctccacctcccaagttcaagcagttctcctgcctcagcctcccaaatagctgggataacaggcacacgccaccacgcctggctaattttttttgtatttttagtagagacagggtttcgccatgttggccaggctggtctcgaactcctgacctcaggtgatccacccacctcggcctcccaaagtgctgggattacaggcgtgagacaccgcgcccggccccaagctttctttaaacagggaaaatatgcacataaaaattcaaaaggcctaggctgggcaagttggctcatgcctgtaatcccagcactttgggaggccgaggcgggcagatcacttgaggtcagatttgagaccagcatggccaacatagagaaacagtctctacgaaaaaaaaaaaaaattagctgggcatggtggcgcacgcctgtggtcccaggtactctggaagctgaggcgtgggaggctgaggcacgagaattgcttggacccaggaggcggaggttgcagtgagccgagattgcgccactgtactccagcctgggcgacagaatgagaccccctctcaaaataaaaatatacatttactgtaaaaatatatttgtccaccacgtggaatgatctggatttgctaacccataaagctgaccgggactcattgtccatggagagcgcactcgccttcctcggggagatggtgcttcgcctccttcctgcacttccagccccactgccccacccggcatgctcatgctgactgtgctttgctgacaatctgcttaggagctgcctcagtttgctgagaagtgaaatgttcttgggggaaccctcagggttgttgtcccggttcctgacactaaggcctgcatttaccatggtgctcagcccaacacaccagacaggcaccgttcccccacctctgccaacgaggagagcccctgggggttaacactgccgctggtgccagcactgatggcagcatggcagtcaggacccaggcctgacagagtccccggcagctacagaagtgcatgctccctctctgcacgggccacttctggtacctcttggtgttgaagtaatttaagtcagaaccccttttattgccccaggggtgaccgggaggccgtggtctcggggctttgtgtttgcaggagtgtggggctggggctgccttttccgcgtcccctggaggagacctcaggcagcctctgtaggtctgaggacccgcctgcatgccaggttctccgggaggctttggacttgggagcctttgaacgtgcccttgagaggcggatcagaagggggcaggttttacgcatcatgtgttgagcccctcacatgcaccctccaaggacctgtcggggatggagcagcttgctggagacaaggggcatggcctcagcggtggcgccggggtgagaatgcaggggttttgccaaggtatctgcacacagcagcccctgccgtgtggcagggacaggatgggaccctggaaggaagaggagctggagctgtgctggaagcagccggctcccctcacttaccgcacattgcagggaccgagagccggggacgctggtgtgtgacaacgcgtggttgttgccacccaccctgggccctctgctgcctctgccgagcccaggtgcactggctggggaaagagtggagtctgtttggttcccgttagaaatagcagggggctggcagtttcatgatcatgtgacccacgtgtgtgtttgcacacgcgcacgaaggaacgcatgcacccttgcacacagcgagaggagttgggcagtttccactctcagcagcg

SEQ ID NO: 468 - DNA, 201998 bp, Homo sapiens
aagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcctcagccccccaagtagctgggaggacaggcgcaagccacggcactcagctaatttttgtatttttcgtagagatagggtttcaccatgttgcccaatttggtctcgaactcctgagctcaagtgatccgcccgccttggcctcccaaagtgctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttttccattgtattaactgcttttacaacaacacaaataacaagttattttacaaaccatttagaaatttctgtactatggtcccagtaatgtaaaatatattaatgcctattacattcagataaattatacacttggaaaccacatacttatgacttacagaaacttacataaacaaattatagaaattacatgctcaatttttaggtatatagtcttaaattaagcttaaatatacattctcaagataaattaacagttcagggcttcacaacttgaaatctgtggaagatgacattggagacaacagaactctggtggaattcttagatggaatttgccgaaacttttttttttttttttttttgagatggagtgtcgctctgtcgcccaggctggagtgcagtggcgcaatctcagctcactgcaagctctgcctcccgggttcacgccattcttctgcctcagcctcccgagtagctgggactacaggcgcccaccgccacgcccggctaattttttatatttttagtagagatggggttttactatgttagccaggatggtctcgatctcttgaccttgtgatctacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtgaaattggaaaagaagccaaatattttatttcacgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcacgcctataatcccagcaccttggaaggccaatgagagtggatcagttgaggccaggagtttgagaccagcctggccaacatggtgaaatgccgtctctactaagaatacaaaaatgagccgggcacggtggcacgcacctgtaatcccaggtactccgaaggatgaggcaggataattgtttgaactcaggaggtggaggttgcagtgagccaaaatcatgccactgcactccagcctgggtgacagagtgagtctctgtctcaaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaattttcggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcatgcctctaatcccagcattttgggaggctgaggctggtggatcaccggaggccaggactttgagaccagcctgaccaatatggcaaaacctcgtccctactaaaaatacaaaaattagccgggcatggtggtgtgagcctgtagtcccagctactcaggaggctgagacaggagaattgcttagattcaggaggtgggggttttagtgggccgagatcacgccattgcactccagactgtgcgacagagcgagactctgtcaaaaaaaaaaaaaaaaaattatcctgcaaaatttgaaaaggaaattcaaatcaacagcttctaaactactttttaacatgactcataataatacattctatagtacatatgtatgttctataactttgaataaaagagttaaccacatcacatttattttataacatgtaatacatattttttattctccttcatttgttttgaatgctctgtgcagtctacaaaaagtccaatagtaataattaaattagtcattaagttgaacattatcttgtcttttaaaatgataatctcaaaaatgatcttttatttttgagatttatatagatacacacacacacacacacacacacacacacacacacacacacacacacacacacatattttttgagacagagtttcactctgtcccccaggctggagtgcaatggcacaatcttggctcactgcaacctctgtctcccgggttcaagcaattcctctgcctcagcctctgagtagctgggactacaggtgtgtgccaccatgcccagctaatttttgtattcttagtagagatggggtttcaccatattggccaggctcgtgtcaactcctgacctcgtgatctgcccaccgcggcctcccaaagtgctgggactataggtgtgagccgctgcacccggtccaagtaaaattattttaacaatatactatgaagagaaaaacactggctatgaaagaatatgcatagttttaccctgtttaaaaataaagattgaaagaatacatatgcaaataagtttacttttatttttggtaacactttactgcattgtctgaatattgacaatcagtatgcattatgaagctacctggctaacattgtgtactcactgtgtgtgccaggccctgggttcaatgctctacatgcacttatatttcatttaattctctctgcaacctgagatggtatagccacctcattttacagagttgaaactgaggctcagagactgaaagttaagcctgaggttgcagtcaataagaggcagagctggaactgaaacctacctgtgtctgaccaccagttcgtgttctgacggcaggctagtctgcatcacagagtgtggagtagatggtgcatgcctgctaggatgggctaggtatcactgtaggtaagaaacagccccaaactatggaaatgtacaccactgaaggctcttttcctgcccatgctgcacatcctccatggctctcctgtgccctgtgccccacatgccctcatcctgccacgagaataaaggagcagcctccatatgggagctgtcagctgctctaagagatgaaggagagagtggcccgtctcaatggctcccaactcttttgcctcgaggtgacacgcttcacttccacgcacatctcctgggtcaaagcaaatcccatgggtacatccactttcaagtggcccaggagagaacctgaaatactcggtggactccattaaggccgtcatatggtgtcagcctgcatgggagactgtggaggggcagaggaggagagtggggaactgatgggaaatgacaggaggactaagtcaccgcagatttgctttatcttcagccaggtggagtttgtcccagagccgcacaaaatcatcaccagcatgattaaacggagtagacttcagaaaaagcagtttggtcggatgtaatcagcagtgaactcagaatcaattgagtgacattgagtcagtaaatctctgactgcctcagttaccccatatgatagttttgaggatgggaacattgagagagttgatttggaaggatatcaagagtaaaaattccaacatttttagttcctttaagttaaatccaggcactgtctttcctgcaagtctcctgttcctttcagattgcacaggtgagagtgctcagattagggctggaggttgtaaaccattgctcccacactgacagtgcccccgtgtcgtgcgtgtattctgcgcattttcctgtgctaaacactctcccaaaacatcgtggggcctgattcttcctctttgttccaatggccctgggtgactcaagtgcccattcaatgaccaggacacagaggtcttagagagatgctccttgaggccccaggtgcgagcctgtaccctgccggagcatgaggcaagggacagggcatcgtctgtggggatagtgggggtagtgggggtagtggtcagccagatttggtgactctacttgctcaccagacgatcctacacctgccacctccgatggatccactgcctctgtgcctgcctgtactgctgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccacttacttggtctctccttttacaaccaccacaaccgaaatctagggctgcttttttttttttttttttttgagacagagtctcattccattctgtcacccaggctggagtgcaatggtacgatctcggctcactgcaacctccgcctcccgggtccaagggattgtcctgcctcagcctcctgagtagctgggattacaggcgtgtgccaccatgcctggctaatttttgtatttttagtagagacggggtttcaccatgttggtcaggctggtctcgaactcctaacctcgtgatccgcctgcctcagcctcccaaagtgctgggattacaggcgtgagccaccatgcccagccaaatctagggcaggaacatggctgcagcatataaaaagaattgaattccatacttttgttaaccctgttttttgtttgtttgtagttgttgctgtttttgagacagagtctcgctctgtcgcctaggctggagtgcagtggtgcaatctcggctcactgcagactctgcctcccgggttcaaactattctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacacccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcatactctgtgtgatcgggcagaaggcctgtgggaagtttagcagaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcaacttggttttctccccctcatttgggttcagaatttaaagtccacacacacaggcagtaagatgatatagataaggacgtcatcactcggtttcggatgttaaaatgtctaggtgggttagcggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttatatgatcagaaacatgctgtgtgatttgattgctctcaaatatattgagatttgctggaacaaaataagtcaggttaatttttgtaaatgtaccaggcatgcttaaaatgaatgtatctacatttgttcccgagatacaggttgatggacggatggctacatggatgtgatggagatggtttactatcgggaccttccgcaccctgctgatgttttgttgcttaggatatgaatggctgagcggaggctgtaaaacctggcactctgcttgggtatgaggttcttcctgccatcctgccatcatttgttttttatgttttgtcgccataagtgaccttgaggaaccctgggagctcaggaaggaaggagcgcccagaagcagggacagggagctggttggggaggaccagaaatcaggtttgtgaaggttccagagaggacctgtctttgggaggagtgtgggagactgagatgggggaggggtcattggaatgatgcgggcgctacttggcattgtccattgtgaggcactgtccattgtgaggcaccaccggggtcatcagggattggtggagagggagtataaagccccagggttggtaagggagggcccagaccgaagaaggtttggtggatagcagaacctttttgtctccctctgattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccacctcctccaggtgcccaacagcccccttctcctcctttcccttcccttacttccccccttcccctccccttcccctccccctcccctccccctcccctccccctcccctccccaactcagatccggccccggtccccgtccccttccctcccccctgccctaagccacctccacctctgtcctggccgcctcagggcgccctgaaaggaccaggacatgcgggtgcggtggatgctcttttggctcctctttgggctcctactggaatttatcagccatcagtgcatctctgtgagtagacgctggacccgtggggtttcttcctttttactgggctgtatcacgtggcatgaaattacacagctcaggcctgtaatcccagcactttagggggccgaggtgggcagatcacttgagtccaggagttgaagactagccagggcatcatagcgaaaccccatctctacaaaaaattccaataaagattagtcgggcctggtggtgcgtacctgttatcccagttactggagaggctgaggtgggaggatcgcttgggcccaggagctggacgttgcagtgagccgagatggccccgctgcactcttgtttttaacaaagaaaatggaccaaaacaaagtgaaatgtcatttgatttgtgtcatctggtttgatgacttttttttttttttttttttttttagacagagtctcactctgtcgcccaggctggagtgcagtggcaagatctcggctcactgcaacctccgcttctggggttcaagcaattgtcctgcctcagcctcctgagtagctcagattacaacgcctggctaatttttgtatttttagtagaccaccacgcctggctaatttttgtgtttttagtagagatggggtttcaccatgttcgccaggatagtctccatctcttgacctcgtgatctgcctgcctcagcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttattttgagacagtttctcccttgttgcccaggctggagtgcaatggggcaatatcagctcaccgcaacctctgcttcccaggttcgagcgattctcctgcctcagcctcccgagtggctgggattacagacatgtggcaccactcccagctaattttgtatttttagtagagatagggtttctccatgttggtcaggctggttttgaactcccgacctcaggtgatccgcccgcctcggcctcccaaagcgttgggattacaggcgtgaaccaccatgcccagccaagatctacactattatgtcaccccagaaagtgaactctcagtcttcccagccagtctctttcttatcataggttagcttgcttattctggaatttcgcgtatacagatgcatgccatgccataggtactcttttgtgtctgctttgttctgctcaacaccatgtttctgaaatcattaccattgttgtatggttctctaacttcatcatttccatttcagactcagcatatgctgagttcaacctgttgaagggctatctctgtttaattcaccatcttgaaagaaacatttaaaattgagatgttttcaagaatatatagttaaatcctgaggaatcgacgtagaaatgttatcacaagctgtctgaacttactcaggggaagtcttcgtcttcactcacataagagtctaatggaattaatatcaacaatcttagagaaatcccacactattcatgccattttcatgatctccaccttgataatttttttttttttttttttttttttttttttttttttttgagacagagtctcgctctgtcacccaggctgaagtgcagtggtgcgatctcggctcactgcaacctctgcctcccgggttcaagtgattcttctgcctcagcctcccaagtagctggaactataggcatgtgccaccatgccctgctaattttttgtatttttagtagagacgggtttcaccgtgttagctaggatggtctcaatctcctgatctcgtggtccacccacctcggcttcccaaagtgctgggattgcaggcgtgagccaccacgcccagcccaccttgttaatttttaagcactaaaatttgatacttatttgtgaatgaagtaatctcttcattgtatttttttttttttttacttatgctgagatttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccaaggcaggtggatcatgaggtcaggagttggagaccagcctggccaagatggtgaaaccctgtttctactaaaaatacaaaaattagccgagcgtggtggcaggcgcctgtaatcccagttactcagtagctgaggcaggagaatcgcttgaacccgggaggcggaggttgcagtgagttgagatcatgccactgcaatctagcctgggtgacagagcaaaactttgtctcaaaacaaaaagaaaagaaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcgtgtaatcccagcactttgggaggctgaggcgggcagattacctgaggtcaggagttcgagaccaccctgaccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgggagcacaccactgcactccagcctgggtgacagagtgagaccccatctcaaaaacaacaaacaaaaacaaaaacaaaaaaatggctgggcacggtggctcacacctgtaatcccagcactttgggaggccgaggcaggcagatcgcctgtcaggagttcaaggccagactggccaacatggtgaaacctcatctctactaaaaatacaaaaatgagtcgggcatggtggcagagacctgtaatctcagctactcgggaggctgaggcaggagaatggcttgagcccaggagctggaggttgcagtgagccgagattgcaccactgcactccagcctgggcgactgagtggagcggaactctgtctcaaaaaaaaaaaagaggttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctgaaaacactaccagccatctgaaaaacatgtgacttctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcatttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagtataagaattatgaaaacatctgccatttgcattatgaaaattaaataggtcggtgtttgtttaatagaatgtcaacagagcttttggtcaaaaataagtttttttaacctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggctgatgcttaaagagcaccctcttctgaggggagagggagatagatggagatgtaggccatttagaggggcagcaaatgatttttaggggaaatgaaagaggccaaggaacaaacaattggcctgagacaaagttcctgtgaggtcatagggacgaggtgacaaactgccggaaggtgaagggcagaactgcactgcgtctcatgatgcagagaaagccccagagactcttagaactgccctccaagagaatcaatgaaaagtgtgtctgggcagggtaattttgaatgacatcattcaaagtgcatgttccgacttggaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttgtctgggggctgaacctccttctgaacaatgatccaagataaaagtactaataccacaatgcttttttatattcaagggaagaggaagtatgtttcagttttaccacctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttcttttttttttttcttttctcaccccgaagacgagtctccttctgttgcccaggctggagtataatggtgtgacctcggctcactgcaacctccacctcctggcttcaagtgattcccctgcctcagcctctcaagtagctgggattgcaggtgcccaccaccatgcccagctaatttttgtatttttagtagagtcggggttttaccatgttggccaggctagtctcaaaacccgacctcaaatgatccaccaacctcagcctcccaaagtgctgggattacaagcgtgagccaccacgtgagccaggggaagtttttaaatttaccactttttaacaattccacttaggaaagttcagttgagctgttggacttggacaacttcgcacctctcatctttgtccttgtcatctagtcatctataccattacctccttagcagggacatcatgggtgccatgaagcattcatgcgtgatggcatttcttggcttctcatttcttcatgtgtttgacatttcccctagctccaaactgggccagctacctttcctatgaaatctagcagtagctgtgggattgacgtggttgctcttttcatctttttagattacccattgcttctctcgaaatcctagtacatgattttttttttatcctatgtgcagaaatcaggaaaaaacaaattctacaaagaatttgaaagatattatttcaggccaggtgtggtggctcatgcctgtaatcccagcactttgggaggctgaagcagatggatcatttgaggtcaggagttcaagaccagatgggccaacatggtgacaccccatctctactaaaaagacaaaaattagccaggcatggtagcaggcacctgtaatcccagctacttgggaggctgaggcacaagaatcgcttgaatctgggaggtggaggttgccgtgagccaaggtagcgccactgcacttcagcacggttgagagtgacactctgtctcaagaaaaaagtcatttcaatgaccacctcaggagattcataggtatctgacccacatctgagatgggatttgcattgcattttagctatgatgagaagaaatatttaatatcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcaggggatgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcatttttttttttttttttttttttgagacgaagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcggcctcccaaagtgctgggattacaggcgtgagctaccgcatctggcctatttttttttttttttttttttttttttttgagacagagtttcaattttgttgcccaggttggagtgcaatggcacaatctcagctcaccacaagcttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccgtgccagcctcatgtcattcttgtgtgtgtgtgtgtgtatgtgacagagtctcattctgtcgctcaggctggagtgcagtggtgtgatctcggctcactgcaacctccgcctcccagcttcaaacggttctctgcctcagcctcccgagtagcttggattacaggcgcccgctgccatgcccggctaatttttgtatttttagtagagacggggtttcaccatcttggccaggctggtcttgaactcctgaccccgtgatccacctgcctcggcctcccgaagtactgggattatacgcatgagccaccgtgcccagccgtcattcttatattattatttcctaggtgtctctcctgaagactatcttctggtctcgaaatggacatgatggatccacggatgtacagcagagagcctggaggtccaaccgccgtagacaggaaggtatggctctgttggaatccgcatagtgtggaaatgagtttgccctggaaagggaaagaacagcttcttgccctcaggtttctcaccttctcctctcctcactctcaccaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggttcaaaattgagtttgtcctttctgcttcattagtttaagctgtataattcctttcccttcctacattcttgttttcattttttcggaggaagaggagttgctagtactggcattggttttcctttctctttttttttttttttttttcctgagatggagctttgctgttgttgcccaggctgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggcgtgagccaccacagccagccttttttttttttttttttttttttaattttgcgatagagtctcgctctgtcgcccaggctggagtgctatggtgcaatcttggctcactgcaacctctgcctcccagtttgaagcaattctgcctcagcttcccgagtagcttggattacaggtgtgtgccaccacatttgaccaatttttttttttttttttttttttgagacagagtctcactctgtcacccaggctagagtgcagtggcatgatcttggctcactgcaacctccacctcccaggttcaagcgattcttatccctcagcctcttgagtagctgggactacaggcatatgccaccatgcccggataatttttgtatttttagtagaggcggggtttcaccatattggccaagctggtctagaactcctgacatgatccgcacacctcggcctcccaatgtgctgggattacaggcgtgagccaccgtgcccggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatatgacattgtattttgctgccatatgactgatctttttttgttaaatgtgagatacttgttaaaaaatgtttagcaatgaattgaggcctagtagcatgttatcttgctgcagaagagatgggagtctacttctgggggatggtcaggggtcctccatacaagctgcaattgaagtcgtcggtgcaggctcagtccctacaaaggccagggtatttcctgtccacctttattctgatgcatgactcttctgggtctcaaccagagccagcggacttcagtatgggtcgctttcattggcagaccctcaatccacttgttttccatctaatcccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcattggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaagctgtgagcttctttagcgtggggacaggaccctgctcccattgcattctcagcaccacaccacacactccttgtttgaggccactccagacagcatgtgctgaaggatgccttgtggtcagaaacaagttcattaactttctctttgaagtgttttcgcccctgtttcctagcgttctgggaattttacacatccttcctataaagccaagtatcaggtgagatccttaggatcaggaccatgaatcaagtggtgtgagggcaacacagcaaacttaccctttttaggccgtttcctttttctgccctcaatctctgtgaactgaaccttgttaaagtcagtcaacaccagggtggatggtttgccgttgtcacctattttcaggacataacaccctgacttaggagccattccgatcatttctaattcaatagatgcgcccagcattcagattgccttttctctcaaccaggatctttaaagttgatgacaagagttccagtcctgaatcatggcaaagtgcagtagtgaactgcggggttattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacacacatagtgcacctcatagaagcttttaatagtctttatatttactaaagaataggactaactatggaactatgaagatgagctggaaatgacaggtgacttgccagcaggccagagtgtgacttttttttgtccctcaatgggaggtgtcaattctcccttcggttgtgagaatcagttggttcatttgtgggaaggttgcaggggggaatctttgaatcacagccttcagatgccagaagggcagagggaatcccacacgggctggtggatcatgtgtgtgcatttctctcccttctaatctgaggaaactaagcgtgaaagaatgtgagcatgcagaaaaggagaggcaggtatcagaggcagaggaaaatgggaaattggatatgaaagaaatacacacctacaagtgagttcagaaactgtaccccaccctcttgggaaacgcccattggagtgttgtttttaacctttgtacagtatttagacccagtaaatgcagaaatagaaacaaacggtcagaagacatatcgtgagagagagcgagagagagttcacaaaacagaaaacaaagtaccttaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaggatattaatacaaagagaatacagctttatgataaaagatgctcaatgaaggatgaattagggatgtactgagaatggggaaggaaactatcatctcagaagtcagcaggcagtaagcaagaggaggaatcaatacagcaacagtttggatcagactgtacagtttttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacgcctggctaattttttgtatttttagtagagaaggggtttcaccatattagccacaatggtctcaatctcctgacctcgtgatccatccgccccgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacagtgggcttttcatgcctctcttactgtctcttactgtctgttgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgactttcctttaccctccagctgtcggcagtactcagtggaagggtgatattatgacactgatacttctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaatactgcagtccttatgttattgctttgtttcgatatctggtatgattgcctgagggacctgaggtttttaatcataggggtttttttttaatctttagaagtggttggttatgtaaaatattattatttttttttttgagactggattttgctgtgtcacccaggctggagtgcagtggctcgatcacagctcactgcagcctcaacctcctgggcttcaagcaatcctcctgcctcagcctcccaagtagctgggatcacagatatgtgccaccacgcctggccaatgttaaaaaatcctttaacttttttgtagagatgcactcctggactcaagcgatcctcctacttgtcccgaccaccagcccctttctgataaacaaacatttacactgtttattatctgatgccatttctatcttcttccttgtcgtccagacatcgaataattaggtttcttcagggttttctttttcaagtgctcagtgttaaagatcactcacattagggccagacaccatggctcatgcctgtaatcccagcactttgggaggccgaggcgggcagagcacttgaggtggggagtttgagaccagcccggccaacttggggaaaccccacctctactgaaaaaaatacaaaaattagctgggcgtgatggtgcatgtctgtagtcctagccacttgggaggctgaggcatgagaatcgcttgaacccaggaggcagaggttgtagtgagccaagatcacgtcagcacactctagcctgggtgacagagtgagactctgactcaaaaaataaataaaataaatatcacttacatgagatatacccaaggggtggtctacagagacttggaagcagtggttattgcaacaggggcacggaagtcatctggctatgccagggtgcccaggggatactcggggtgggtggcatggtgctgctggggactcatcgcacaggacgctctgattgacgcactgccaggagtagcgctctgtcttggggctgcagccggcctcctcagctcgagtgtaacatcagtcgtggccatggcagcacctgcggatgtcacatgggcaggacagcaggtgggtgaagctctctcctggccctcctctcttgccaggaccatgggtgactgaagacccccagggaggcacagcatcctcttatctaagatttttttttttttaagagacagggtctttaaaaaagtcctgcagtctgcagtcgcccaggctggactgcagaggcacaatcatagctcacggcagccttgaactcctgggctcagcgatcctcccacttcagtgtcccaagtagctgagactacaggcacacgccagcatgtccggctggttttttagtttgtatttcctttgagacagcatatctctctgtcgctcaggctggggtgcaatggctcaatcagctcactttagccttgaactcccgggctcaagtgatactgccacctcaacttcccaagtatgctactacaggaacacaaactccttttttaaattttttgtggatatggggtctcactatgttgcctaggctggtcttgaactcccaggctcaagcagtcctacctcagcctccccaaatgctgggattacaggtgggagctactgtacgcctggccttatctaagctgtttccctgaaaatgcccgtcttgggtaatgattccattggccccaccatgccctgtcctgccttcctggctgtgcccaagcttggtccctgcctgcctgcctcactctctgggtctcgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctcttgtctctataacaaatttaaaaattagctcaccaggccaggctcagtggctcatgcctgtaatcccaacactttgagaggccgaggcaggtggatcacgaggtcaggagttcgagagcagcctgaccaacacggcgaaaccctgtctctactaaacatacaaaattagccaggcatggtggcacgcacctgtaatcccagctactcgggaggctgaggtaggagaattgcttgaaccccggaggtggaggttgcggtgagccaagatcacgccattgcagtccagcctgagcaacagagcaagactctgtctcgagagaataaaaacacacaaaaaattaactcgccaggatggcacatgcctatagtcctaactacttgggaggctgaggtgggaggattcccttcagcccaggagtttgaggctgcagtgagccactgtgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgtctgggtaatttttgtatttttagtagagacagggtttagtagagaccatggtgaaaccccatctctattaaacaaatctctactaaccccatctctacaaaaaacagctgggcgtggtagtgcacacctgtaattccagctacttgggaggctgaggcacgagaatcatttgcatcttggaggcagagtttgcagtgagctgagatcgcaccactgcactccagccgggatgacagagcaagaccctgtctcaaaaaaaaaaaaagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaagaaaaaagaacaaacaacagcaacaacaacaaaaaaacctctgtgtcaatcacagccttcgagctaggggagaggcggccgaattctgccctccgctaacgagctatagctttgtggaaatgggcgagtggcgtgcccttgtgagcctcagggccgcatctgtaaaatgggcataactgtcatgcctgtctttaagaacagccttgggggtaaatgagtggaactaatggaaagatctcagcccacaaccttccacagaacaggcgcttctcacacagtaagtagcaggagtgcagaggctgcaggcatgaatccagtcagactgcagactgcctgggttcaagtcccagctcccacgtcttggtaactaagtggcctcagacaagttacttagtatttcttcttcttctttttttttttttttcagacggagttttgctctgtcacccaggctggagtgcagtggtgtgatctcggctcactgcaacctccgcctcccgggttcaagcaattctcctgcctcagcttcctgagtagctggaattacaggcacctgccaccacatccagctaatttttgtatttttagtagagacagggtttcaccatattggccaggatggtctcgaactcctgacctcgtgatctgcctgcctcagcctcccaaagtactgggattataggcgtgagccaccgcacctggacacattacttaatatttctgtgccttggtttcttcatctgtgaaatgggattgttgtgagaatgcaaagggattcccagggcagttcctagtgcatagtctggctgcctttgtgtgtgtgtgtgtgtgtgtgcatgtgtgtgtgtgtttaatatagagacagggtctcactatgttgcctaggctggtttcaaactcctgggctccagtgatcctcctgcttccacccaaagtggtgggataacaggtgtgagtcaccacacctggtcactttatattatttttttcttttgagacagggtctcgcactgttgccgaggttggaatgcagtggtgcaatctcaactcactgcaaactccgcctcccgggttcaagtgtttctcctgcatcagcctcttgagtagctggtactatagtcaccgggctccttgcctggctaagttttgtatttttagtagagatgcggtttagtgattctcctgcatcagcctcttgagtagctggtactataatcacttagctccttgcccagctaatttttgtattgttagtagagatgcggtttccttttttttttttttttttgagatggagtttcgctcttgttgcctaggctggagtgcagtggtgctatctcggttcaccacagcctccgcctcctgggttcaagcgattctcctcctcagcctcccgagtagctgggattacaggcatgtgccaccgcacctggctaattttgtatttttagtagagacggggtttccccatgttggtcaggctagtctcgaactcctgatgtcaggtgatctgccttccttggcctcccaaagtgctgggattacaggcatgagccagcatgccaggctggcccttttttttttttttttaatcacttaacatatatcttggagaactttccattttgggagttaaagagatttgtttgtttgtttgttttgagacagggtctccctctgtggcccaggctggagctggaccttggctcagtccaacttccaccccccgggctcaagcaatcctcccacttcagccttccaagtagctgggtctatgggcacatgccaccacatcccgctactttttatagtttttgtagagataggattttaccatgttgcccaggctggtcttgaactcctgagctcaagtgatccacctgcttcagcctcccaaattactgggattacaggcatgagccatcttgcccagcctgttttttatttaatatctactaagtgccaactaccatagaggacataaagatgattcagtctctgcagaagtcattttctttctctttcctgttgtacagcacaaaattaatggactaaatagtctgtcactagataaagaagccctaagtaatcaggcacttgctgcagtttttacaaagtttaaaaagccatatgaaacacagtatactccaagtaataagaggcaaaatatgtgaagtgttactgctggggaatttacggactattcttttctacaatatatctgctgtggtctgaatgtgttccccaagattcatatgttaaaacttaaccaccagtctggtagtattaagaggtggggcatcattaagtcatgagggcatgggattagtaacctcataaaaaggttggcgggaacgagctaggccctttcattgcccttacatccctctgtcacttgaagacacagcactggtccccccgggaggacatagcagcaaggtgccgtattggaaatggccaccatgccctcaccagataccaacctgctggtaacttaatcttggccttcctagcctccagaactgtgagaaagaaatttctgggttttgtttgtttgtatgagacagggtctctgtcacctaggctggagtgcagtggcacgatctcggctcactgcaacctctgcctcctgggttcaagtgattctcccacctcagcctcccgagtagctgggattacaggtatgcaccaccacacccagctttttttttttttcatagcgttgtacagatagggtttcgtcatgttgcccaggctgatctcgaactcctaaggtcacacgatccacctgccctggcctcccagcatgctgggattaaaggcgtgagccactgtgcctggccaaaatttccgttttttataaataacccagtctctggtactttcttatagccgcacgaacagataaagactgtacctatctgttgactgggcgcagtggctcacgtctgtaatcccagcacttcgggaggcttagacaggtggatcacgaggtgaggagatcgagaccatcctggctaatatggtgaaaccccgtctctactaaaaatacaaaaaatttagctgggctcggtggcgggcgcctgtagtcccagctactcaggaggctgaggcacgagaatggcatgaacccgggaggcggagcttgcagtgagccgagatcatgccactgcagtccgtcctgggcgaaagagcgagactccgtctcaaaaaacaaacaaacaaacaaacaaacaaaaaagaccgtgcctttctgtctgtctccctcataggtcagtttccacctgattgtaaccacatcaagtatcctagtatatttcatatttacagaaaaataaatgggcaaatactgtcatttacagagaacctgccctgtcctgtacactgtgacatattttgtggtttgtgattatgtgctctgatccttacgatagctctaaaatagctcaaaaagttattcccattttgtacataagaaaattgaagttctggaaacataaggcaattgcccaaagtaatagagtaaatgacaaagctaggatttctttctttcttccattaattaattaattatttgagatagggtccctgttgtgggatgcagtggggagatcatagctcactgcagtctcgacctcctgggctcaactgatcctcacgtctcagcctcctgagtagccgggactacaggtgcacaccaacactatggctaattcttgtatttttctgtagaggtctgcctaggctaggcagagattctggctaggctggtctcaaactcctgggctcaagcaattctcctgcctcaccctcccatatagctgggaccgcaggtgtgtgccaccactcccagctgacttgtttataccagtggttcttaattggaagagttttgtaccccggggacatttggcaacatctggagatgtttttgaatgttacagtggggaggaggggaatgctactgtcacctactgcgtagaggcaagggatgctgctgaacatcccacaatgcacagaacagcctcctccccacccaacagagaagtatctggttggcccaaaatctcaatgatgccaagtctaagaaactgctttgtatttctctgagatactgggatgaggaacgctctaaattagttgtctttgaggataatgtatgcatacatacacatatatgtgtatacatgtatataactaaagatatatagttgagatcttgcatttgtgttaatgaatgtagtttttataaagataattgactcatacattaattgttgactctttggaaaggaaaaaggacaaatgagatacatgctattggttttgttatttagaaattgttcgtgtggatcctccctaccattcagccatttgcaaaccattagttgagcataacttaatcccttctagttcacagcaaagattcatcaaaagccatttggtatactgtcacctcatctctctaccagtgttgattagattacaggagggttacaggagggcaccttatccaaattggccaatgataaattcttttttggtaccttactatatatttgtatcctcagaacaaattctcctttctgcttaagctggcttgacttcatttctttcactagcaagctaagaggctttggccaacagaactactctaggggtagctgtaaaatttatctctaaggaaaggctgctcttttgaaaacacagtttaatgggtcttctgggtatatgacgatagtaaagcaaaattttgttctggaatgaagaagctgattacattgttgtattacaaacaatatattactcagtgaagtgaaaggccacactgtgggcagggtggtgactttgcagatagcatgttaatccttgcatgctttttgttgtttctctttttggagggggagggtcttaattttctttggccctcccccaccccctttattttctctggggaaggcaagactggataaggaggcttttatcctgccaagatgagttggcccacaggacaatttgactgaatagaggctccacaaagaacggacatggccaaagaattacaacaggaaattatgcatttagttttaaggcttcctttttctcctttttttttttttttttttgagaccgagtcttgctctgttgcccaggctggagtgcagtgttgcgatctcagctcactgcaacctctgcctcccgggtccaagcgattctccagcctcagcctcccgagtagctgggattacaggtacctgccaccacacctggctaattcgtatttttggtagagatggggtttcaccatgttggcccggctggtcttgaactcctggtctcaagtgatccacccgcctcagcctcccaaagtacagggattacaggcatgagccacagggcctggccagtatttttcttgtataatgctcagagtttcctttaaatctttttaaaaacttggcagccttagtcttagctgtgctttgggaaaataaggagctgcactcaagcttaagaagatattgctggaagtgtacattggcacagccttcgaagcttcttggtgccctcctgtaacccaatcgacactggctagagagatgaggtcatattgcatcaaatggcttccagtgattctttgctgtggacaagaaagttgctctttttctttgagaaagttgctctttttctttgagagggagttttgatgcctaggctggagtgcaatggcagtgatgtcggctcactgcaacctctgcctcccaggttcaagtgattctcctgcctcagcctcccgagtagctgggattacaggaatgtgccaccatgccaggctaattttgtatttttagtagagacagggtttttccatgttggtcaggctggtctcgaactcccgacctcaggtgatccacccatgttggcctccaaaagtgctgggattacaggcgtgagccaccacgcccagccaagaaggtcactctttatgctcaacaaatgtattgcaaatggctgaaaggtagggaggatccagatgaacaatttctaaataggaaaactaatagccagacacgatggctcacacctgtaatcccagcattttaggaggtcgaggcaggcagatcacctgatgtcaggcatttgagaccagcctgggcaacacggagaaaccccatgtctactaaaaatacaaaaattagccaggtgtggtggcgggcatgtgtagtcccagctactcaggaggctgaggcaggagaatcacttaaacccgggaggcagaggttgcagtgagctgagcttgtgccactgtactccagcctgggcaacagagagagactctgtctcaaaaaaaaaaaaaaaaaatcgtagatatccaatttgttcctttctcctttcctaaaagctttttgtgccccctccaacccaacagttccaccctagaaaaacacttgtacacatacatcaggaaacgatacaagaatattcaggctggtcgcggtggcttgcctataatctcagcattttgggaggccgaggtgggaggacggcgagagatcatgccactgcgctccagcctgggcaacagagggagactccgtctcaaaaaaaaaaaaaaaaaaaagcataatgttgaaaacaaacagcagtataatacagcatggagataactttataaaatgcaaagacaaataaaagtaaatatagtgcattgtttaggagtataaatatggtaattatgcaaagaaaactaaaatgacttttaaaaatcatgatggtgactatttttgggaggaaagcaggtagaaggtgggatctgagagcagcacacagtaagtgtcaattgtcctagttaatgttcggcttcttaaattgggtgatatgttcacaggtgttcattatgttcttttttttttttttttttttgagacggagtctgactctgttgcccaggctggggtgcagtggtgcgatctcggctcactgcaagctccacctcttgggttcatgccattctcctgcctcagcttcccaagtagctgggactacaggtgcccgccaccacacccggctaattttttttttttttgtatttttagtagagacggggtttcaccgtgttagccaggatggtctcgatctcctgacctcgtgatccacctgcctcggcctcccaaagtgctgggattacaggcgggagccgctgcgcccagcccattatgttcttataacttacattaacatattattttatatatgtcaagctttttttcccttttttttttttaagagatgagattttgctttgtcacccaggccagagagtgtcgtggtgcagtcatagctcacagcagcctccaactcctgggttcaagtgattctcccacctctgtctgccaaataattggaactacaggcatgtgccaccatgcctgggtaagtttttttttttaattttttatttattattatactttaagatttagggtacatgtgcacaatgtgcaggttagttacatatgtatacatgtgccatgctggtgcgctgcacccactaactcgtcatctagcattaggtatatctccgaatgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggatgtgaactcatcattttttatggctgcatagtattccatggcatatatgtgccacattttcttaatccagtctatcattgttggacatttgggttggttccaagtctttgctattgtgaataatgccgcaataaacatatgtgtgcatgtgtctttaaaacagcatgatttatagtcctttgggtatcctgggtaagttttttaaaagtgttatttgtagagacggagtctggctgtgttgcctgggctggtctcaaactcctggcttcaaggtatcctcctgcctcagcctcccaaagctctggcattacaggtgtgagccactgcacccagactcagactttttttaagggaaagaatgggagtgtaggtggggagacacactttgggaggccaaggtgggaggatcacttgggccgggggttcaagaccagtctgggcaacaaagtgagacctcgtatttaccaaaaatacaaaaaattagctgggcttggtggtgtgggtttgggaggctgaggtgagaggattgcataagctgtaggagcccgaggctgcaacgagctgtgatcgcgccattgcgctctaacttgggctagacaatgagatcctgtctcaaaccaaaacaaaacaaaacagataattgtcaaattgctgttttgctattgttgctttttgtttttgcttcgctttgccttggaagtgaagaagagattctcatttaaacagttatcttgaagtatctttgtgaactagggtgcaattatttcctctgtccttgagacacagatgattcctgtccaacattcccaaggaactcagtaaggaccaaatagagactcaggaaagacagttactgattttacactgttgcaaaacagagctatggtttatgtttaacaaactgctggtggggcgtggtggctcatgtctgtaatcccagcactttgggatgccaaggtgggtggatcacttgaggtcaagagttcgagaccagcctggccaacatggtgaaaccctgtctctactaaaaatacaaaaattagcagggcatggtggtgcatgcctgtaatcctagctactggggagggtgaggcacaagaatcgcttgaacctgggaatcggaggatgcagtgagccgagatcacgacactgtactccatcctgggtgacggagcgagactgtctcaaaaaaaacacaaaaaacaaaaaaaccaaattgctgtattttattttgtgaaatagggtctagctctgttgtccaggctggagtgcaggggtgcaatcacagctcactgcagccttgacctccagggctcaatcgatcctccctcctcagttttcaagtagctgagactacaggtatgcaccaccatatgctgcccaggctggtcttgaactcctggagagagatacatacacacacacacacacacacacacacacacacacacacactttttttttttttttgagacacagtttcgctcgtcacccaggctggagtgcaatggcacaatcttggctcattgcaacctctgcctcctgggttcaagctattatcctgcctcggcctcccaagtagctgggattagtaaggcactgccaccatgcctggctaattttgtatttttagtagagacagggttttgtcatgttggccaggctggtctcaaacttctggcctcaggtgatccacttgcctcggcctcccaaagtgttgggataacaggcatgagccactgcgccgggcccatacatatgcattttaaaaaatttatttatttatttcgagacagggtctcactctgttgcccaagcaggagtgcagtggtgctatctcccaggctcaagcaatcctcagcctcccgagtagctgggactacaggtgtgtgccatcacacccagataatttttattatttttattttttaaattttttgtagagatggagtttcaccgtgtcacccaggctggatatttttgtatttttgataggcctgtacagtttccaaagttgcaacctttccccctccctgagagtaggggcagccccggctctccctctacatcctccacagtcccgaggttttggcctctgtttcctctgtttcctatgcttggaacaccagtcgctcttttgttggtctggctgacttctgttcctcttttaaaaatttaagtttggccgggtgcggtggctcacgcttgtaatcccagcactttgggagtccgaggcgggtggatgacctgaggtcatgagttcaagaccagcctggccaacacagtgcaaccccgtctccactaaaaatacgaaaattagccgggtgtggtggcatgcgcctgtaatcccagctacttgggaggctgaggcaagagaattgcttgaactggggaggcggaggttgcagtgagctgagatcacgccactgcactccacctgggcaacagggcaagactcggtctcaaaagaaaataaataaataaataaataaataaataaataaataaataaagtcaagggggtaacacctcttggtaactctcctgttgtttctcatgccagcatcatcacagccttgaggctctggggtaggtcacttcgtcgagctcgtttccatgaggataacgttatcttgggtgtctgtgagaatgctgcactgagtatagagcccaggctcctgggtcagccgggttcgaatcccctttcctccgtgaagatctgggtcagtcacaagtgcttcagtttcttcgatctgactgagggaggctttgactccaaaaaattaacacttgagtgtacctggccacagcttagcacatccagggtgtttccaccctttctttgggatcctcagggctggatggagccgatccttcccgtctctccttacactcgcgcactcacgctggctggaacaagtcctccaagtagaacgaagagcgcgttttagcggcgctctagcccgccgagagcatacgccctccccacacggggcccctgattgtctgaaggttgcgctggcacgcgcaacttccgggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttcacagaaatgagctcattcctcctaactgggtaatagacatgggtggggcctggaaaagtgagtatgttctctgttctggaggcccactttcccgactgtgtctcttcgtgatttcccaggcctgggtactgccttctgcgccttgacccctcttccttccctcttcttcgtccaaatttggaagggatttccctgggctatgtgggttatcagccgaacgttgtcactcatggcaaattgaatattacatcttttttgtttgaaatttgtttcgacacacgtatttgtttcgcagtctttattttgctccacttttaaaatccctaacccccatagcactcttggcgtttaactttcagagtcattaggatgctatgttttttcattaatttactacgtgtaagtgaagcaaaccttgtaaaacaattagcgtaatatgattcctaatatttatcgagctcctgcttactgtgttaaacactggggacagtggtttatccaaagacactaatgtccctgctttctacagagcttacagcatagggtgggaaggcagtacacaggccaataaataaacgaacacgatgatttcagttatacaacaaggtaatgggggagggagaagggagagaaggagtgttcgagatttctcattgggaagacatctgtcatttcagcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcagggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacagtaagtgaaatgagaaacagcttggcttgtttgaagagcagaaaagacatgatggctgtagtaaaacaagttgttggagatgaggtgagagaggtaggcgggggccagattaatgtaggattttaaagaccacactgagagatttggattgttactgtaagtgcagtgggaagacagttattggttgctgagcaaaggagggattgttggttaagagtggaagcagggagaccagtaaagaggccttaacaatagtcccactgaattatgttggttcaataaaggttggctattataatttttattattttcatgaacttaatagcttgttaatcttggttccacaggatttcaaatatgcgtgcattagagaatgattttttcaattctcccccaagaaaaactgttcggtttggtggaactgtgacagaagtcttgctgaagtacaaaaaggtaagaggagataatgtgtgaggtttgcttttggtcaggtcagaatacaactattgctgttatactaaagaccaatagaaatagcaagattaattaagataccagttgaaatcaaatatttaataatagcatgatgccgtcagtgcaaaattagagtaatagtgtcctttttttcccccaccttggcccatttcacaggtaataatgagagagtaataatgtctttactgaggtttcacctcttcaaatgctttatttacaaagcatcttttaactttagcaagtgctagaattaaaaacaattacagcattttatttatttatttatttgtgctggagtcttcctctgtcacccaggctggagtgcagtggcgtgacctcagctcactgcatcctccacctcccaggttcaagcaattctcctgcctcagtcttctgaatagctggggttacaggcacgcaccaccacacctggctaattttttaatttttttaatagagacggggtttcaccatgttggcctggctggtctcaaactcctgagcttgtgatccacccgccttggcctcccaaagtgctgggattacagatgtgagccaccatgcctggcctacagcattttattttttgaggaacttacctaagcattactttgggacagtaaaccggttctctgaatagggatttttgtttttgtggtagtttagaagcatttctactatatctcagcagtagagggaaaatgttaagtaaccgtatgtttatatgaaatatccatttgtatccatatttgagtgaatacttttttagatcctcctgaattagatcattagagctggctgttttttcccctcatgctttttgagaattcgcaggagtatcaactattatattcaaatgtcaatacagaagtatagctaaatgtagtttatcattttcctttttccaagccctctggctgcactaacatgagtgtttaaatttttgtagtcatgattttataatccgcaattgacatgtgaaagttagtgttccttttataatttcatctgatgttaaagtacggttaaaagtcttgctgttgatactaaacaggaaacaaaagcataacttaattctttccccttcttgttaagggtgaaacaaatgactttgagttgttgaagaaccagctgttagatccagacataaaggtaattaattttgtgtttgatcattagcaaaattattgccactttatacagacatagtttgctctttgggtcccattctgttctgcagaacttgctctctccatggtcctcccttactttaatctggtggttctcaaccagggacagttttaccccctagaagacatttggtgatggctgcagatatttttgtcacaactgggaggaaagggtgctactggcatctagtgggtgaatgacagagatgctgctaaacatctcacagtgcacagggcagcctcccataaccaagagtgatccagccccaaatgacaacagtgttgaggctgggaaaccctgctctaatgcttcctttctattagattactacctctttcctccatgctgcatgcaactcttttgtctctttaaagctaaaacaaaccaaaaaaaaaaaacaaaccactgtttcagcatttccaggttcgagatacacctatcatgtagtaaaaccttaatacattttgtttcaccattcttcctttactgcccagttttgaagagaatggtttattaccatggcagtggtagttagattgcctggaatgaaattccaattttattatccagtgtgtgatcttgagcaaattgttttaacctctctgcctctattttccactgtgtgaaaccaagaaaacaatagagatttaaaaaatatggagtgttttgttttttaagagatgtggtcttgctgtgttgctctagctattcacaggtgtgatcatagtgcactacagccttgaactcctggcctcaaatgatcctttctcttcagccttctaaaaagctgggactataggtgcatgccactgtgcctggctttaaacatggaaatacttaacaaggattcaatgagctaatatgcaagaagcacttagaacagtctctgactcaaagtaagggcagtaattgtcatctgttgtttttgttccagctgactgtgctgtatcatttctcactcacatttaagtccactgttcttatcactgtagtaattaccctgacagattacccatgttttttttttacatgctgatttcagtggactttttttgagacaaagtctccttcttgtcacccaggctggagtgcagtggtgtgatatgggctccctgcaacctttgcctcctgggttcaagcaattctcctgcctcagcctcccaaatagctgagattacaggcacccgccaccatgcctggttaatttttttatttttagtagaaacggggtttcaccatgttggccaggctggtcttgaactcctgacctcaggtgacctgcctgcctcggcctcccaaagtgctgggattacaagtgtgagccactgagcccagcctcagtggacttacttttttaagccttgtattccttgtatcagccgacactgttggccacccacttcttaaaacttcagtgtttctgatcctcctgtcttctgatcctttaatctctctctttttttttttttttttttttttgctctgtcgcccaggctggagtgcaatgacgcaatcttggctcactgcaagctccacctcccgagttcaagtgattctcctacctcagcctcccgagtagctgggactacacgcgcccgccaccacccccagctaattttttgtatttttagtagagatggggtttcaccatgttagccaggatggtatcgatcttctgacctcgtgatccacccgccttggactcccaaagtgctaggattagaggtgtgagccaccacacccggccagtgatcctttaagctctagtatctctcgataggttcttgatcttaaatttggtgttgattgggcttcaaaacttgactcttttctcactctgttgattcttctgtgtgatctcctcatctcccttcatggctttgaaatctacctgtgtcctaatatatttgtgtctgtagccaagattgctcttgtgggctccagacttatttcattttcatttttggggatgggcagaacagagtcttgctctgtcacctaggctgtagtgtagtgggatgatcttggctcactgcaacctctgcctcctgggttcaagccatcctcccacctcagcctcctgagtagctgtgccaccacgcccagctaatttttttgtattttcagtagatttggggtttcaccatgctggccaggctggtctcgaactcctgacctcaagtgatccacccgcctcagcctcccaaagtgctgggattatagacgtgagccactgcacccggcctagacttgtttcttaactgtctgttagatgcatttacccagaatcatcatagatgctccaaacttatcatgtccactcttggctgggctccatctttcatggagctttccctggttctctctaagcacatggttgttccttcattgagtctatttcccacacttccagatctctctagttacagatctggtttacaaggccctccatggtctatttggtgcttctttgttccccagatttattatctgttggcttggtcactatacatgccagccatactgaacatttttcagttttctgaaaacatacttttccttctgtaagaagcagaacttccagaaaagactcaactgtgttactgtttaaagacagctgaagcatcactttctctttaaagcttttcctgacccctgcctcctttcccagatacaaagggacattttctttgtgttccactgtattttgtatcagcagttctcattcttggtattttgacataccaagaattgcactagttgtgtggagtgttgcaagtagaacttttttcgtcttgagacagggtctcgctgtgtcacccaggctggagtgtaatgggcccgatcatggctcactgcagcctcaacctcccaggctcaagcaatcttcccacctcaggctcccgagcacctgggaccacaagcatgtgctaccatgcctggctaatttttctagagacgaggtctccctatgttgcccaggctggtctcaaattcctgggctcaagcagtttcctcctgccttggcctccgaaaagtgctgggattacaggcatgagccactgttcctgcctgctagtagaaataataatagttcagtactaaagcatcaaagtctgcaactgatttacttttttttttttctttttgagacatagttttgctcttgttgcccaggctggagtgcagtggcatgatcttggctcactgcaacctctgcctccgagttttttaagtaattctcctgcctcagcctcccgagtagctgggattatgggcatgcaccaccacgcccagctaattttgtatttttagtagagacggggtttctccatgttggttaggctcgtctcgaactcccaacctcaggtgatccacccacctcggcctcccaaagtgttgggattacaggtgtgagccaccacccccagcctgatttacttttaaaaatggtacagtttaaatgttatccttatagttttgttgcagtctttttagtggaaaagagataggatagattattttatttacacactaacttagcttgttttctacatgcctttggccttagtgagctaccgttaatgttatccttaacagttttggacatatgaaattaccatagtacaaatgagttgtggttttactttattttactgccaggctacttgggatttcatcagaaaatggttgatctgtgggagtttgacacatggatatggcatagtaagcactcagtagctgaattaaggtggggaaaaggggacagcttcttctccgcatatagggaggcatgtgggatggtggacagaggatagccttgaccgagacagatgggtttggacctgcttctttactggcctcttggttgggcagattgcttattaatcgttcttagcctcagcttcctgaacagcaaaatgggaataactaaacatcttgcagagttcttaggattagaagaagatatatatgcggagtgtcaggcaccatgcctggcatatggtgtattctcactaaatgataactccatatgaatatccctgtaggtatgatgaccttgtgttgcttttatttatatgtctaagccttccacaaattaggggctttttcttaatggtttttgtcctgtgcagtatatatgcatgaatataattaatatagtaatattttacataattgacactgtattttataccttgcgtttcaaatttagcagttcttctcatgtcactaacaattactatgaacagtaatttgattgcctgaaaaatatttcatggaggaatggggctatcatttatacagaacaaacacatcataatatatttaaactcagccacagatttggtttagaaaagttatgtttattcatgaccccaattgatcagcctagactgaattttatcagcatgcttcctggtcagcttgaatatagaggaaatagaggtagctattgttcctttgtgatcttctaatatttcaatctgctagaattctgcagtttttaaaagtcccaggtgtcaacatttgaggtgatttcactttttcagggcaaacaaaagtgatcaggctgaagtattgcatttaagtctttctcctgtgtattagagttactagattactttcttaaaacgattaagtttattgtgacatctttttctgttttaatacccagttttgatttccttccaagtttgtgaccttttccccccaacctattcttgataaatgattgatataagatagctgtaaatttctgttatcttagaggatttgtgattttgaaagtactctttgtttaacttaaggatgaccagatcatcaactggctgctagaattccgttcttctgtcatgtacttgacaaaagactttgagcaacttatcagtattatattggtaagttcaccatttattttactgtcaagtatgtaattcagaactttggtaatagtatatgttatattaataacatgctgcttttatctttcttcccccactctagagattgccttggttgaatagaagtcaaacagtagtggaagagtatttggcttttcttggtaatcttgtatcagcatagactgttttcctcagaccgtgtctcagcatgattgcttcccattttgtgcctcgtaagtcattactctttgcttgcttggaattttcttttcttttctttttaatacttctttgttaaaataccaccttccccttatatatgagagactgctaccatggaagattccagatgcatattggcaccaggtctggtagacatatattccccgtaatgacccctatggaggtgtctagattcatttgttgctgtgagtttgatgaattataacttgctttattgaactcctggtgaaatctaggaatttttagccatttaaaaactataaagttgcattactttttttcagattgtgcatttaattaatcattgggctaactttggattatggaaaaataactttttttatagctgttcattgtctaggtcaataactttttttgtatagccattcattgtctagatcaatgacagaacaacatattttctttttccctcaaaagcccgagtgatcattaaggaaggcgatgtagatgtttcagattctgatgatgaagatgatagtaagtataaaaaggtttaaagcctgggcacagtagcttacacccataatcccagcattttgggaggccaagatgggaggatcacttgaggccaagagtttgagaccagcctgggcaacatagtgagaccttgtctctgcaaaaaaacattttttttcaaatattttcttaaaaaaggcttaaagtagaactaggcagggtagtgtgtgtctttagtcacagctacctgggaggcttaagtgggtggattgcttgagcccaggagttcaagctctgcctggtggcaagactctgtcttctttaaaaaaaaaaaagtaaagcacagaatacctggcatctattctaataagtagactgcaacaaatgacaacttttgatgtaatctttttgttatatttaccattgatatgcagtcagttgtcctgaatgcattatttatataattagtccatttaattttcattgatgctggtggagaaaagtcttgaaattattatttctctgataaattattccgttttggttagcatgtgtttttagcttcaagtatgtcactttttgtttgtttgtttgttttttgagacagagtctcgctctgttgcccaggctggagtacagtggtgtgatcttggttcgctgcagccttcacctcctaggttcaagtgattctcctgcttcagcctcctgagtagatgggactacaggcgtttgccaccatgcccggctaatttttgtatttttagtagagatggggtttcaccatattggtcaggctggtctcgaactcctgacctcaggtgatccacccacctcggcctcccagagtgctgggattacaggcgtgagccactgtgcccggccagcatttatttttagtttcaagcatgtcgcccttcagttttgttttgatgctcatactctgaacttttcttctttcagatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccagttctggccgggcgcggtggctcacacctgtaatcccagcactttgggaggctgaggcgggcggatcacctgaggtcgggagttcgagactagcctgaccaacatggagaaaccccgtctctactaaaaatacaaaattaggtgggcgtggtggcgcatgcctgtaatcccagctgtttggggggctgaggcaggagaatcgcttgaacccgggaggcagaggttacagtgagccgagattgtaccactgcactccagcctgggcaacaagagcgaaactccgtctcaaaaaacaaaaaaagttccagttctttgaggtaagggttcctgtttgcctcctatgtctatcgatatttgcttttagaatggtagttttcctttttattccttttctagaaagtaaagtcaacatggattgatttaattttttaaaaatagggcaccgtggtttctcatgccaatactggtggaaaaatttccatttgttcgaaaatcagagagaacactggtaagaaatcttttcattgagaacatcatggaaaagttgtttgtatgatttcattttagatgatattaggtctttttctttctttttctgtctttatttttatttttcttttttgagaccgagtctcactctatcgcccaagctggagtgcaatggcgtcatcttggctcactgcaacctctgcctctcgggttcaagcaattctcctgcctcagcctccccattagctgggactgcaggcacctaccaccatgcccagctaatttttgtatttttagtagagacaaggtttcaccatattggccacactgttatcgaacgcctgaccttgtgatctgcctgcctcggcctcccaaagtgctgggattggtgaaccaccgtgcccggctgatgttaggtctttttcttaaaggttactttgtcttctagactttaaactgatgtctaagaatttgactcagattcctttcttataaagcggctattggggattcgcagtgcctttttctgttattactatgtgcaagtcaaggtctgagttcatttccggaatatctgtagtggctttatgctcatacgggcaagaattactagaagataatagttcatgtattactaattgtgaacatgccttattttaacctgaaaacaaagccttccatagaagaattctgcttaagtttttgtacaatgttcagatcatctgtgcagtttttaataattaatagtggttgccttagtagaaaaccgaatctagtagcatacaaaaagaattacgtaccatgaccaagtgcgactgatgttaggaatgcaagattgattttttttttcgggggtggggggacagtctctgtctgtcacccaggctggagtgcagtggcaccatctcagctcactgcagcctctgcctccagggttcaagtgactctcccacctcagcttcccaagtaggtgggactatagacatggggcaccacaccccactaatttttgtgtttttggtagagatggggttttgccatgttggccagactggtcttgaactcctgacctcaagcgatctacccgtctccacctcgcaaagtgttgggattagaggcgtgaaccaccgtgaccggctgagattgagttagtacctgaaaatgaattaataaaatattttgtagcaatagaacaaaggacaaaaaccacataatcatctcagtagatgcagaagtgtgtgacaaacaccaatatccctttatgagaaaaacagaaggaaattttctcaacctgataaagggcatctgaaaaacccacagctaacatcatattcagtggtgaaagaccaaaagttttttcctaagacaaagaacaaaacaaggatttccgctcttgctgcttgtctagccaaggcagttaggcaagaaaaagaattaaaagcatccagatggaaaggaaggcgtaaactctcttttgcatggtgattttatatgtcattctaagaagtttacacacacacaagaaattttagagataataaatgagttcagcatggttacgggacagaagactaacatacactaaccagttgttcaagacaattgaataggggagaatagtcatttcaacaaatgctgctggcagaagtggatatgaacatgcaaaagagtgaagcatatggatatccatatacaaaaatgaactcaataaaagccctacatgaagtgtaaaaactgtaaaactctgagaagaaaacgagtacattttcataatgttggattaggcagtaatttccagatttgatgcctaagcacaagcaaccaaagaaaaaatgcatcaattgtacttcaaaattaaacgttgttatgcttcataggacatcttcaagaagatgaaaagaatccccaaataatgggaggaaatatttctaaattttatgtctggtaatggacttgtatatgtaaagaactcttataattgaataataaaagggcaaatagcccaactgaagagggcaaaggatctgaataggcatttctgcaaaacacatgaaaagaagctcaacatcattagccatcagggaaatgatttcacttaatgcccacaaggatggctataatcagaacgagaagacagtaacaagtgttcacaaggatatggagaaatgggaacgttggaactgtcatatgttgctgtgagaatgtaaaatggtgcagccgttttggaaaatagcctggcatttcttcaaggttaaatgtagaattaacacgtgactcagcagttccatttctgggtttatacccaagagaaatgaaaatatatgtccacagaaaaacttgtacatggatgttcatagcagcagcatccataatagcctcaagtagaagcaactcaaatgtctgtcaactgatgaacagatgacaaaacatggtacaatggaatattactcagcaatgaaaaggaatgctttatatgttacaacatgattggaccctaaaaacatgccaaaaggctgtgtattatatgactccattgataggaaaggaatggtttacatgttacaacatgattgaaccttaaaaacatgccacaaactgtgtatgactccattgatatgagaggaatggtttacatgttacaacatgattgaaccctaaaaacatgtattatatgactccatttatatgaaatgtctcaaagaggcagattcatagaaagactagtggttgccaaggtcttcattttttaggggtgcactaatggatgtaggatttctttttagagtgattaaaatgttacaaaattgctggctgggtgcagtggcttatgcccataatcacagcacttcgggaggctgaagtgggaagatccaggagttgaagaccagcctgggcaacatagtgagaaaatgtctccctaaaaggaagaattaacctcatgtggtggtgtgcacctgtagttctagctactagggaggctgaggaggaaggattgcttatcccgggaattcaaggttgcagtgagctatgattgcacccactgtacctcatcctgagagagagagcaagaccctgtctctaaaagaaaaataaatgttctgaaattgattatgttgacggtcacataactgaatatattaaaaacttaaattgtatactttaagttggtgattgtatgatatatgagttttatcaatacagctacttaaaaacctatagttatgcaaattaaaaatttcatttactggggataattgaaatgattataccgaacataatacatgtagaaacagtatagtttttgtattgctggatagtctgtttttttctttttcaatatttgaaactaaaggtcatgtaattgatgtttttcttacataactgtgaaatatttattctctgttgaaatgttttatcttacgttttctcctttaggaatgttacgttcataacttactaaggattagtgtatattttccaaccttgaggcatgaaattctggagcttattattgaaaaactactcaagctggatgtaagtattgagtaatctatttttattttcttttttttattttttatttttttattttcatttactgacttgaatttgttataatcacagtatgtggaaacaatagtcagtgatagaaaagaatccacttggccaggcatggtggctcatgcctttattcccagcactttgggaggccgaggcaggcagatcacctgaggtcaggagttcaagaccagcctggccaacatggcgaaaccccgtctctataaaaaaaaaaaaaaaaaattagccaggcatgatggtgggtgcctgtaatcccagctactcaggaggctgaggtgggagaattgcttgaatccgggaggcagatcttgcagtgagctgagatcgtgccactgcactccagcctgggcgacagagcgagactccatctcaaaaaaaaaaaaagaaaagaaaagaaaagaaaccactagcaccattctttgcttcctttctttgaatgtgtcttgaactccatctgtgcatgtgctgggagttgtagacagttccttctcatgattggagaacaaggcgttaaatacatagttatccaaatgtaaaagtatggttgtggaaaatgccatgaatgaaacatacattatgagttagagaacctgatagaatcacagtggggtcaggaagggattcctacggaagtgatttttcctgtttggcctttcttaagggcagattataattataaacagttaaaactttgtttaaggaggcccgcactaaggtgcagtgggaatgaaaggaagtggtagattctagtgacattgtgaggaaaggtgaactggtccttgagactggtttggaggaggggaggcagacagtaagggaaaggaatccttcaatagttgctccctgtggaatcgaatcttggtgttgccattaatggtagttagaaatatgaagaggaggctgggtgtggtggctcacgcatgtaatcccagcactttgggaggccgaggcgggcggatcacgaggtcaggagatcgagaccatcctggctaacatggtgaaactctgtctcactaaaaatataaaaaattggccgggtatggtggtgggcacctatagtcccagctactcgggaggctgaggcaggagaatggtgtgaacctgggaggtggagcttgcagtgagcccagattgtgccactctgctccagcctgggtgacagagcaagactctgtctcaaaaaaaaagaaaaaaaaaatatgaagaggaggcagttggaagagtagttccatcttggccaggttcagttgctggtgggcagcctaccagagaatactcacaggcagtcgtggctgcagatggggacctgagcataaacctttggaaagatgcagtttaggacaggggaggagaagggtgatcagaagtatggggaaaaccaagagtctggatgctcaggaagaatccgctggaaggaggagtttggtcagcagcatcagatactgctgtcattttttagaaagatgaaaagagcaacagtccttggatttagtggttagaaggtagtctttgttgctttctggaggaccatgtcagtgaagacgcagaaactgcatttcgggagaggatgtggatggtggggaagcagaattggggctgttagagaccttggtgcagggttgtggtggaaggaggggatggagcagggctaagaggcgtggtttaggagtggggagatgtgagcaggtttgtggactgaggggagaggagctttggtggaggaaaacattgatgctataggaaagcaggaagatggaacaaggtcttagaagagctggagcttgggctcactggtgcagtgctcccttggagttgcacctctctggccaactgtatatgtactctttatagtctttctctggtatatacttaaggaacattttagaatgtttacaaagaaggtcaggcatagttaataaaaaatggcatggtttgagtggtatgttaagatatttgaatggtgatataccaaaataaatattgcatcatgcacatttggcttgcagttcatcatttttctgctcaattgattgacgatatgtttattacacaatgtgtctgtgagtgtcttgtgcatagagattgtattagtccattttcacactgctgataaagacatagctgagcctgggaagaaaaagagatgtttttgtttgtttgtttgagatggtgtctcgctctgttgcccaggctggagtgcagtggtgcgatctcggctcactgcaacctccacctcccgggttcaagcagttctcctgcctcagcctcctgattagctgggattacaggcacgtgccaccatgcccggctaattttttgtatttttagtagagatggggtttcactgtgttagccaggatggtctcaatctcctgacctcatgatccatccacctcggcctcccaaagtgctgggattacaggcgtgagccactgcacctggccaaaaaagaggtttaattggacttacagttccacatggctggggagccctcagaatcatggcgggaggtgaaaggcacttcttacatggtggcggcaagagaaaatgaggaagatgtaaaagtggaaacccctgataaaaccatcagatctcgtgagacttattcactatcatgagaacagtatgggggaaacctaccctatgattcaaattatctcccaccagtcccccccccaacaacatgtgggacttacaggagtacaattcaagatgagatttggggccaggcgtggtggctcatgcctgtaattccagcactttgggaagctgaggccggtggatcacctgaggtcaggagttcgagaccagcctgactaacatggagtaaccccatctctactaaaaatacaaaattagctgggcacagtggcacatgcctgtaatcccagctactcaggaggctgaggcaggagaatctcttgaacctggggggcggagtttgcggtgagccaagatcttgccattgtattccagcctgggcaacaagagcaaaactctgcctcaaaaaaaaaaaaaaaaaaaagtgagatttgggtggggacacagagccagaccatatcagagctagaataaatgttgaatttgttgaggctacctgacatagagcatcatgtgatagttgtcgattttatataagtatgtagtaaaaggggcttggtttattatatttaaattccttcatgacctaggtcagtttacaggcttgcaccataattgtgtattgtgttggggtgtgatataaggcactaatctggacaccttgaacgtgtgtatatcagatgaatttccatcccaaaataacatagttgtattttttaaatccttttattcttttttcccccccctttgttataggtgaatgcatcccggcagggtattgaagatgctgaagaaacagcaaatcaaacttgtggtgggacagattccacggaaggattgtttaatatggttagcagtttattaatgaaagtggagatgaagtttatcataatcaaagggtggaaacagctagtgctgctcatctttgttaaggctttagattgaaagaattaaaatagtttagcaaacttgaaaacgattccttatatgagtaatttgctgccatgtcatttagcacttagcataattggtctatttccaaggctttgaatttgggtttggtgaagtatgtttcacttttgttgttgtaactttcagtgtttgtttttgtaagccagatgctgtctgtgagggcgtggctaatggaaaagcataactgtttaatttctgcattttaccacttgtacactttatagcattacttcttacgagtagctgggaccacagattaccatgcctggctaatttttgtgtttttagaagaggcggggtttcaccatgttggccagactggttgtgaactcctgaccgcaagtgatctgcccgcctcctgccccgcaaagcgttgggattacaggtgtgaacaactgtgcctggcccacgttcccttctcagtacacttggagagaaaacagattgctgcctgccagcccagctaggtgctctgaaaatgtcatcctgcctttggtcactaggtggtggtcttcccttaagcctttctctattaaaatctcatatggggtaattaacagtatttcctttattctttccaagggttgagttgtaactagcccaaaccaacttattaatctagaattttaaaaactttaggctttgacttttcttcttcttcttctttttttttttggtgggggaaagaatatagaaggcttttccttctctgcaacgattttgtggcttcctagaggtcaggagagtgttggtcatgggaaagaaggttgaattcagtctgcccacatgggcgtgcctagctttagaacagcgctatttaggagaagttggaagttacaccctttggtgagaagctgtgtctgtttttttccatgattggcataattaactcaaataccagctgtacattagtccgtatttctgttcatggttgagttcagtgtgtccagagaccggaaggtgctttgcactcacaggagtgcccatgtggagctccatgggatgtgaattattgttggtcactagttctggctgacattggaatcacttgaagagtttttataatatgtggattccaaagccctgtcacaaacctattgaatttgtacctcccaggttgaattttttgttgttttttgtttgtttgttttttgagatggagtctcactctgtcacccaggctggagtgtagtggcatgatctcagctcactgcaacctctgcctcctgggttcaagtgattctcctgcctcaacctcccaagtagctgggattacaggcacctgccaccacgcctggctaatttttgtatttttagtagagagagggtttctccatgttggccagtctggtctcgagctcctgaccttgggtgatccacccgcctcggcctcccaaagtgctgggattacatttacaggcgtgagccactgtgcctggccctgggttgattttgatgcttagctaggtttgggatccattggattatttaacacccgaggtgccttttgtttctaatgatattctctcaacgtgttttaaaaatgaagcccatgagatagttatgagatagtagaacttttccctacattggtgaagtaaaaatcttgggattttgatagtcagattatcttaggcattaaaaaatatcacaccgatgccctctctttttatagggattcgcagaggcatttttggaacatctttggaaaaacttgcaggatccaagtaatcctgccatcatcaggcaggctgctggaaattatattggaagctttttggcaagagctaaatttatttctcttatgtaagtagcctaatttgccgagtactttttaatatcatgctttaaaaagagtatagcattgtctcaagtcagaaatatctcccatatgtttttggcatgtttttaaagtgaataaaattcctactctgtgcaagatgtttatatttctaagtggtgattttagaataaagtgtctccttttttattataaaaccctgtatgtaaggcttttgtcatctcttttgtgtggttgcacttaaagatccatttgttttgtggatagaggacagtgttgtatactgttttgattctttttgtaggtttgtcatttttttcatttgcattccaaatctattgtatctgttaaagctgaagaaaaacccttttaaaggtaatagacctatctaggaggccagtttctttcagtggcccatgaagatatctttggacaaggatgctgttgaaacccttccccaagaacaaaattattcacccataggacttgactggatgcatcagggaatactgaagtccaccagactgtctttctcttgagacgtgttggtgaacatgtcctatttggccaatcaccctaagaggggtgcctttgagatggttaggagaacctgctttccatcccttgggacgttcttaggggctcacctgttcctagaaggtcagagctactctgccttgtaattggaaggttgtcttcctacgcacccatccttatccttcctttctttgcttttcctctgtacccatgggtattatttaaagaaacctatgaacttacttagcatggtttgtaatgaaaggcagttgtgtgtttttatgttattctggtttttttatgaagtgtaaagttgacttgaatttttcttttctctagtactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtcagtgttgtgggagtgctggactggattttccttgtgttcttgtcacccttcagaatggtgattcattacttttttgagatttttataaaaactggattcagaaaactgcatgtacactcaaacttctaataataatttcaagcagctcataggcccctacaaaccccttaagatagatttgagcttgagaaccctacaaaccccttaagatggatttgaggttaagaaagaggtttctgcctttgaaggtttgaaatgtgaagatgtctccagaggtgaggctgagccctgggctgtgccagcgccctgtacaaagcttcagttggatgcaccttctctttgttgtccttgtaacagcccagtaaatggcaggtattctccctttacagacagcaccaaagcacggggaagtcattttcccaagatcacatggttactggcaggattagaaaactgaagccaggttcagctgaccctaaagtttgagtttatatagattacactctgcctgaagccttgagacttaattgaccagtattgttttgctaatttctaagagttacttataattcaaatctatcagttgaaacttactagattagcgtattttagttgaagagagtctccaagaacagtgtttataagtcattgtaaattgttctgtttatgtttatgaataattcatatggttttgtgggtcacttcctctaaaccagggtctgtcaaccctgcatgattgccatttgggctgcatcatccttcatcgtcgggggctgtcctctgcactgtaggatgtttaacagcctccacctactagctgccaacagcagtccctgaccacccccagctgtgacaactaaaagtgtctccagacactgccaggtgtcctctgtgggggttgcagtctccttaggttaacagccacagctctaaactgacagttgtacgtgttgcattatatatgtttacctacatcctacatgcttctaaaagatgttgtatgaactagtaggatgaggttttatcacaaggtaagtaaatacaagctctgcttttctttgtataaattaatgccaggaatctgaattaaatatcttgtttttgtaagcagtgacatcccatttaggtaatttttattgaaatatgcatcaaagaaactcctaagaaaatatacttaagtacaagttggtcagcttgcctcttaaaataaatgtgatgtctttattttactcatgtaggaaagaattgtattcactaagtctaagaaagtggcttctgtctaaatttgccgtccgttgaggtagaaggcaaatttggagttttcttgtttagaaaaaaaactacagatgactactgtgcacctgaaaacagcactcagcttcactaacgagacatgcaagctagaatcaaattgctgttttgttttgttgcctgtcgtgattgttagctgaaaccaaatcacaaggtctttttctccctctgtattagctcagcatacactgagcttacaaacgtatgaacttcacgttgtcgtggaatcttacagcctgctacttcctaagtttcctttagagaagctgccttggtgaccaatgaatgtggttagcctagtgatactcttctgggccatatactgtgtgactatctgcatggacctttattgaaagcatttctgcaaataatttttttaagttttttttaaatgtgtgataatttgtgcttttaaagatatcttacacttttcacttatttgtacctttaaaaatcttttttttttttaaaccaaaggtttgcagtatcctcagagtctgaattttgagcggatagtgatgagccagctaaatcccctgaagatttgcctgccctcagtggttaacttttttgctgcaatcacaaagtaagttatttatgctttcttgatgggagttatttaaaatatttttatttatgtttctctagtattgtaagagtctgttaaatttctatgaaattagtaacattataaaaggccaggcgtggtggctgacgcctgtaatctcaacattttgggaggctgaggtgggaggattgcttgaggccaggagttaaaagaccagcttgagcaacatagtgagaccctatctctataaaaaaattttaaaaattagctgggtgtggttgcctgtgcctgtagtcccaactactcaggaggctgaggtaggagaatcacttgaacccaggaggcagaggttgcagtgagctgagatcgtgccattgcactccagcctgggtgacaagggcaagactccatcaaaaaaaaaaaaaaaaaaaggaatttctgcaatacgctacaacatgaatgattttgtaggacattacgctaagtaaaataagccagtcacagaaaaacaaatactgtatggttctacttaaaggaagcccatagagttgtcaaaattagagagacagaaagtagaatggtggtccccagcggctgcagaaagacagagtggggaaattattgtttaatgggtacagagttttcattttacaggatgaagacttgtggatatggatggtggtgatggttgcacaacaatatcaatttattttataccactgaaccgtgcacttcaaaatggttaagatggtaagttttatgttgtgtattttaccataataaaaaaaattgtagagggaaaaacagtctgcctccacttttgatatgggactgctaacatcttccaccctccctctccccctctgccccacatctgggcaagctaagaaagcctgctgctctctcctctggcaccagctggaaattcatacccaacaagccctagccctcccaccagacccacatttcatccccatccccatcgcatccccatccccatccccatccctaaccaccataaatgctaagggagtttccttgcctggttttctgaaaccatttttggacctgcttgggaatctgccctgctctctcagaaagcttcattatatgagcaataaaccttttcctaccctcttggtgcatgtggtgtatcatcagtcttgacatctaaaacaaattttgggtggtggggtccatgtctttgcagggtgaccacaatagtacctggcacattatgtgtttaataaacagagattactgtcatatttattttattttattttttgagatgaaatttcactcttttttcctaggctggggtgtagtggtgcgatcttggctcactgcaacctccacctcccgggttcaagtgattctcctgcctcagcctcccaaggagctgagattacaggcatgcgccaccacacctggctaattttgtatttttagtagggatggggtttcaccacgttagccagactggtctcgaactcctgacctcagatgatccacccaccttgacctcacttacaggcgtgagccaccgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaattttgaggataaatatctccaggttgaggaagaaggttgcacatatcgggtgctcaataaatatttgtcgaatgaatgaatgagtgaatggccccagtgtgtggggcttgggaagtgattggatataggcagagaaaaggaacaagtcaaaaataattcagaaatcaagaacaagcaagttgccttgatatacttcattcctacacttggcaaactttagtgattaaggaaacaatgttttaaaaaaagttttggtgatgagacattcaggaagatctatcaataaatagcaaacctggtcctttttaagacactgtgtataaaaaaattccaaaaagattaaaatcagtgcagaaaccaaagaaccatttttttctatatcatattgatcatttcaagtggaactgttagctatcttagaaaaattgtggttctcaattggttttgcctctatctctgaaccaccattcctaaaggaaaacattcaaccagaaaatttcagcacatcacaatctctctgaagattaagaagtctctgtgaaggactgaatgtataaattgaaaaatttttgctgtcacatttaggtaaaagagaaatcgttcttcatatccccttcctttccatctgtagctcacctatgtcaactttcctctcagaagtgaaataaaattaaagctatgacactgagtgtcagtcatggagggacacgttccccacttagcctttgctgaagtgtttccagagacaactgtctaatgccaggtccccacttagtgggctgcacttttctactcatttgcacataatccagaagtcacattttgggttcacagtttccactggggtaacctcattaggcctggccacctctgtgcttcttgtgaagtctctgatttgaaggattagtatcctttccagactgtgtgggttgactttcacccatctggagttgcttggaacaaagataactacctcaactccttgtcatgaaagcaaaaaaaaaatagcattagagttctgagaacaggatgtcattacgggttgtgccttgtcagctacaggtaagatatttgagtggctcctcaagcctccccaactccctctccaacctcgctacacagtcttcccaggtctggtatttgacctccagactgccgcccagaaagcaactcagagctcagcaacaccatgatgatgaaacacaaatatgtgggcccccaactttggagactccactggttgcttttgtgcagctctttctatatatgactttcaaaatggcagccaaccctctcaactgttggttgatctgaatatgtaaagttcagccttcaaacccagcaaacagtcagctataggatagagttcaggtgctggggaatgaccacggttggctgctacgttgggaaccctggtgacatcatatatggacctgggaatgtaaagaaacgtaggaaatctgaatttatgacttttctaatctctctatcgggatccttttttggaatcaagatgattttccttctaaaaggtcattttattacagtaatgggcagggtagacatacctcactagcgtactctcaaaatttcttgcatgcatatgctttctccggcatgcatatgctttctactacaatgtgaacaagcctacgaaagctagcctaatggaggatgagagaccacgtggaggagagctgaagtgccccagccagcagctagcctacacccacagctattttgcttgtgttccactcgtcctatttgcataatattgttctttaagttaacccattcttaatttattgttttaatcttaagcaataatattcaagaactaatgagttttgtgtattcattatatttttccataatatatattatactaataaatgcccattcaaatttttgtttgagtgctcaagtgggtatcatttaaaataatcttatatactatatataacagccaaggtttgggcaacacaacagaaactgcatgagtttattttatcagaattttttaaacggtatgggagaactaaaaaagtaaaaaagggaacccttgagttaacaaggagataagaactacgtaaagcagttactgtcctgaaggaataaagggaagagcatggggttattagaacctagaagtttggaaccaccaggagctgggaccctatgaggagagggttggcccctgacaatgctggtgtctctaagggagctcctgaggctgattctagcagtgtagggaaagaaactggaaactggaacaatttcctctgtaatcaatgacccttgccagggtaaagaatcactgctgaagagatgctactggaaaagcaagcaaacaaaaaggagggtgtcccttccccttcttccttccttccagtctccctcatgacagagcatctggctggtgacgggaaaaggtgctccacagagcaccaccccaacatcacacgggcatctgctgacccacagctgactgcagatgaggaagctcagcctaggtcacacaaacgcctcccagctgagtctagcctaaattgccaacctgccaaatcatgaactaataagtgactattgttttaagccactacctttaagggaattcagtatgcagcaatagctatctgatccatataggcctacaaggctatagaaaaactatcacatgtaatcccagcactttgggaggccagggcgggtggatcaactgaggtcaggagttcgagaccagcctgaccaacatggagaaacctcgtccctactaaaaacacaaaattagccaggcatggtggtgcatgcctgtaatcccagctacttgggaggctgaggcaggagaatcacttgaacctgggaggcagaggtttcagtgagccaagatcgcaccattgcactccagcctgggcaaaaagagcgaaactctgtcaaaaaaaagaaaaagaaagaaagagagagagagagagagaaagcagagaggctactgcagagaaaagtctagaaggatgggttcatgggttcatcgagagacaatagcttaacaaccagcacaccatagttggcaaaacactatcattgaaaaaaaaacatgctcaaaaggggaaatgccagtttgggtaaatatgcttttgtgttggagagaaagaatttggaacaggcttttcagacccccttaaggcccaacaaacaaattataatttagacaagtctgggattcttcacagctcagcttgtggtgatggtattagcttcacaactccaaacaagttaagctgtctgtgtgaaatctcctcaacaacacctcactggcaaacctggaggtgctgaaaacagagctttcaattcttgtttgcaaccaagggagttgagttggcagatgggcactgtgtccagccttgggaaaggacatcgcagactttgcatcctaagaactcataaccacaacggcaaggtaagacacaagctcttgaaagtttccatcacagtgcagcacaaatgaccttggctatgtgccctgttattgctggtccctgcttaaaaatctcctgtgacttccaaccacacaaatttcctacctggttgcaaaaatgcccttgataattcacccctccctctatcttgccccctttacaatgtggcttggcagctcctcccatcaagagttaaaatctatttcctcaccccttgaatctaggctggccatgggacttgctttggccaatagatgtggcagaaattatggcgtgacagttctaagcatgagtctcaagaggctttgcatgcagcaactttctcttagaaccctgccaccatgtgaacaatcctgcctgggctagcctaatggaggatgagagaccatgtggaagagagctgaggtgccccagccaacaaccagcctaccccagaagcagaggcatctgctgacccacagctgactccagatgcataagggagctcagcctagatccagaacgcctcccagctgagtctagcctagactgccagcctgccaaatcatgaagtaataagggactattgttttaagtcactaccttttgggggaatttgatatgcaacaatagctctctgatacatataggcctacaagtctatagaaaaactatgctgcctctctctccagccacacaatttctttctcttctcatttactattctaattcctctgtgttatagtctgtgtcccaaaattcatgtcaaaatcctaatctccaaggtaatggtattagaaggtaaatctttggtaggtgatcaggtcatgagggtggagccctcatgaatgggattagtaaccttataaaagagaacccagagagctcatttgctgcttctgccatgtgaagatacagtgaaaaaagaagcaggcccttgccagatacgagtttgccaatgccttgatcttggaattcccagcctccagaactgtgagcagtaagtttctattgtttataagctacccagcctatggcattttgttacggcagcctgaatggactaagacagtctacctagaccattatttccctttcatcatccaccagccaattccagcacatcttttagatctcagcttaaatactccctccaagacctccctctatctctaatatgaatgaaatccatatctcaagttcttcacagaatcctctactctttccttcatggcatttgtcataatttgtaattatatatctagcaaagttctttgttgttaaacatctacctcctccactctcctagaaactccacaaggacatccctgcacccagtgcctaggcaatgccagacacatagcagatgctccattaattatctgtcgaatgactgaatggcttccaagttagttaactgggcacccttgataacagattctggcctatttgaaggatcaaagaagaaagtggtgctaccttctcccctgccactatcttgcccacttgtggtgccagttcaggaggtttggaatggatgtggctaatgatagacgtagacctattgcctttcttggatcataattctgccaggctctgagtccatgtggcatcgatggctaattgtcctccaaaatttatcctctcttcttccatttataccctcccatggagttttaacagggcatgtggtcaccctactgggatctcacttctcagcttcccttgcaactggatgtggccttgtgactaaattctcatgaacagaatgtgagtgcaagtgatgtgtcagtatcttcatcactttcctaaaaagggaactgctggtcctccacttcctctctttcacccttccaatgagccagaacatgcatgtgatgctggtgagtcagcttcagtcacatgaataaaaacaaactccaggagatgactaagcaataagacagaaggaacccaagtccctagacgagttcacagaaccaagctacctatccaaccctgggcccacctggattataacatgagaaaaacataagtcctaatcatatttttgaagcactgcattttagggcttctttgtgacagcagcctaccctctagtctaatcaatatacctcaccaagtctcctgctcctaagggagacaaagaagcaaaatgagtctcaaaacatcatccaaatggaatagatacagacctgtaatcccaacactgtgggtgcccaaggcgggtggatcacttgaggtcaggagtttgagaccaacctggccaacatggcaaaaccctgtctccactaaaaatacaaaaattagccggacgtggtgttgtgcacctgtaatcccacctacccacgaggctaagccgggagaattgcttgaacccaggagggggaggttgcagtgagccgagatcatgccactgcactccagcctgggtaacagagtgagactctgtctcaaaaaaataaataaaaataaaaataaatagaccattaattaatagatatagccttggtctgtgaccaaagctcagaatgttatgatattcctttcctatgtcacctcaacttgcccctgtcatcagacaggacaaattccccactggtcctttgcactcacagctgttacatttgaaatgggagcttagccttccctgccctggttcctccttagactcatttgggaaaacaggaaacgtaattatttctgccattacctttatctcatggagcctgacagagtgtaaccaatggtaggaattaaaacattctaattgccaactcacaacaactcccgaaaaaaatcattttaactcattatacatattaaattatgacatgcttaatgtccaaacctaatagattcagtactcaggaaatcccttatacaggtagacacctttcctcctgtactttaagaaaatcttacatcaatatgcgggacttctcaaatttttctatcacagttttcttaataggaaggagaatttgtgccaaaagatgtatggaaatttagcacaaagtagccctctacaagcggaggatttctttaaagcattgtgttttatctcaagattccatggcaaatgtttatcttctctgcttgttttagtatgaaatagttttcatttgcttgtcatcatttttaaggagttgaaaatacaatcaacctcactcatcataaaataaaagcaaattaaaactactatgacatattttcacctacaaaattgagaacattttaaaatgtgataatagttctattaacaagggtgtgagaagacaattctcaggcagggcatggtggctcacacctgtcatcccagagctttgggaggctaaagtgggaggatcgcttgagctcaggaattcaagatccacctaggcaacatagtgagactctgtctctacaaaaagtaaaatataaattagctgggtgtggtggcatgcggctatcatcccagctactggggaggctgaggcgggaggattgcttgaactggggaagaccaggttgccatgagccatgatcacgccactgtattctagcctgggtggcaggaccggaccctgtcccaaaaaaaaaaaaaaaaaaaaaaaaatccctcttccctgattggtgggactgtaagctggtgcaacctcttgggaggagcaggtggttagaaaacatgtatcaaatttttatgcaaaatttaaatagacccacaattagaccctaggaatttattctccagatattctcatgcatgcgtgcaaggtatatttgcaaagatttgtatccagcactatctgtaattgcaaaaatccagaagcaacctcagtgtcaatccttagaagactgtgtacatgagatactgtacatgttggttgggttctccgagaagcgcatgcccggatagaatgcaaaagattcattagggagtaacacctctgccagaaaagcagaagagataggattgggcaggaggggccattagagcacaatttagagctaccaccatttcagaaggcagcaaagattgcctgttagagaaatggtcaggcccttgtaccctcagtcactggatgggagccactccaagaagagcatgaccatgacttaacagctaaggggaccctgaaagagctgccaggttaaggctatcagctcctcactccccacagctggacagagagcctttgtttaaggaggatctgagcagctcatctccaggtctggcacaagggttacccataggatgaagatggaagacatgaatctatatgtattagtatggaacaatctccatgatagatttttaagtgaaagagcaatagtaaattgcaaaagagaacataacgttttgggactaggcagaagtgataaccgaacaacagtgtgaatggagtaaaatgtcaccgaattgtacactttaaagtggctaattttgctatgtgaatttcacctcaatttttttttttttttttgagatggtgtttcactcttgttgtccaagctggagtgcaatggcaaagtctcggctcaccacaacctccgcctcctgggttcaagcaattctcctgcctcagcctcttgagtagctgggattacaggtgcgtgccaccacgcccggctaattttgtatttttagtagagacggggtttctccatgttagtcaggctggtcttgaactcccgatctcaggagatctgcctgcctcggcctcccaaagtgtgggattacaggcgtgagccaccgcgcctgaccccatctcaatgttttaaaagagagagaatacagcatgctgtcatttgtgttaattttaaaaaggaaatgaatttatgtgcatgtataaatgctagacatggaatctctctgaaaggagccatgaaacactcatactatgatctccagtcaggaaagagacttaattttcactgtacgcccttggtgctgcttaaatttttatcatgtgcatgtaattacaccctgtctttaaaaatcattaaagatgtttaattgttctgatgaaggaatacattacttgccatcaagaaaaatgaatgaaaaattttctgcgagacaatttttagcaagacactgttgtattgatcattcaagttcagaaaattcagcctccgtcaaggggcacaaacatcatatatcaggttcagtttgtcctctctctcagagtcaaagtgctttaggaacatagacacaataagtttctggaaccaaatggcaaatatcaaaacttgctagaacaggagaaaagtgtatcttattgaaaattcaccagctgctataccattcagcattgggaaaatcagcataccttcttagacttcattattttaaagatggcaaaatagccaagtcatggatgtctccccctttcatcaaaatgtaaagaactagctgcctctgggactctccaccaattttcaagcacgtcttttgaacccatttgatggtgtcactcaataagggcacctttttcaacttggctgcctctttttgacccaaaataatttcaacccttttctgcagctccgggcttcaccaggctttctattattgcatatacctttcatagtgattctaaaccgacctcgaatgaagagacaaatgattttttatctattggtttgattgcacttctccttgtactgctccaagacaaggcttgtcttttgagttgcaaaaaatactagcgctctatttccaaagtcaaacaagtggcttttcaatgtctctgcaagtgttttgtttcatgcagtcagtgctgacttttctcgatggagagacatatggtttgggcccattttagcaactctataataaaactgattataaaaataagcatctaagaatatcttaggcttttaagattgacaccactgcttgctactcaattgctagttgtggttggcagtgcacgcagtgtctttgtggtcaagttcattgtggcaagctcagaggtcatgtcagatcacaacacagggactttgaattgggtggacatccattcattacgtggcacacgtcacgagcttcaaggttttgcttcaaaaactcttctgtcttctaggtgaaagtataagtttaaacttactgctctttaagaaagtaaatgaaaaatgacactaaagtcccaaaagccagaattgtcagcaatcctaggtgcagttcattcattcattcattcacgtattcattcaataaatatttatggagggcctatttacctggcagcacttcatgaggccctggaaatacaatagtgagcaataaaaacacactccttcaccaggtggagctatagtctactagggagatatagatgttaaacaaattatcacacaggccgggcatggtggctcacacctgtaatcccagcactttgggaggccgaggcaggtggatcacctgaggtcaggagtaggagttcaagaccaggctgactaacatggtgaaaccccatctttactaaaaatacaaaattagctaggcatggtggtgcatgcctgtgatccaagctacttgggaggctgaggcaggagaattgcttgaaccggggaggcagaggttgcaatgagctgagatcgcaccattgcactccagcctgggcaacaagagcgaaactccaactcaaaaaaaaaaaaaaattatcacacaaacaagtacataattctatattgtgaagtgtcccaaagaaaaatatgccactcttaataagtacaggaggcttaatttggaaagttagaaaagtgatgtttaaagtgagaactgtaagacaagtcactttgtcagtgcaaagtggaaagaaagtattttaagtagcaaggagagcatgagtaaagaccacggagaaggaaagcgaggatgcagttagagacatgaaaggactgcattggtggggcaccgggatgaaggagatgatgaagaagatgtaaccagaaaggctggcagggacaaggtcatgctgggtcttgcaggccagcatgagcacttgagattcttaaagtaattgcaagggagcctttgagggttttaatgagggcagtatctttatcagatgtgcacttgtttggggtttctctggattttgttgaaagaacaatttaagcagaaggcagattaggaaataggagaatcgagaggctgtatatgttgagacgcagtggtagtctagggtgacaatgcaggaaatgggaagcagtggatgaactggggatatgttttgaaggtagaatagatgatggctgggaagacagtgactattcaagggcaggggggttgggggaggtatcaagaatgtttagaatatagctaaccacatacccttttagaaacagtcttctctgaacatttctcctgtctccaagcctcagtttcctcatctatgaaataagaacactactacttcctttttaaggttgttaaactggttaaatgagattatgcagggaaagcatcactagtcagtgctcaaaaatgtgctttttaaatttcctccctttgcctcttattctcaactttgtcctttgtaatattattgttctttaagtgggcttggttttgtcctatctttgcccattcactcactgctccccatccacccaaatcccctctgtattctgtttatgcaagactgagtttaccccttctcagtccattgacttatctctcctcactcattgacttgtcccaggcaatttattctgcaatcttggacaaaaatctggattttcagccaggtgcagtggctcacacctgtaaacccagcactttgggaggccaaggcgggtagatcatttgaggtcaggagtttgagaccagcctgaccaacatgacgaaaccctgtctctactagaaatacaaaaattagctgggtgtggtgacgtgtgcctgtaattccaggcatgcctgtaatcccagctactcgggaggctgaggcaggagaatcgcttgaacccaggagacggaggttgcagtcaggcgagctcacgccactgtattccagcctgggcaacaaagcgagacttcatctcaaaaaaaaataataataattcattatgtaatccagctttgaaacactctttggctacacttttgtatgctttaaggaggaacaaaacacagatggtctccaacttacattggttaaatctacaatttttcagctttacaatggtgcaaaaacaatgtgcattcagtagaaactgtacttcaagtacccatacaaccattctggtttgccccttcagtacaatgttcaatgaattatgtgagatattcaacactttattataaaacaggctttattttagatgattttgcccaaccttaggctaatgtaagtgttctaagcatgtttaaggtaggctaggctaagctatgatgttcagtaggttaggtgtattaaagcaagttttacttaagatattttcaagttacagtgggtttattgagatgcaacctcattgtaagtcaaggaacatctgtacttcagaagtcatcaaagctgcatgagcaggacacaagtcatatgaaaagccaggtagacataatgctataaaaaatccctccattgggccgggcacggtggctcatgcctgtaatcccagcactttgggaggccggggagggtggatcacgaggtcaggagattgagaccatcctgactaacacagtgaaaccccgtctctactaaaaatacaaaaaattagccaggcatggtggcgggcacctgcagtcccagctactcgggaagctgaggcaggagaatggcaagaacccgggaggcggagcttgcagtgagccgagatcacgccactgcactccagcctgggtgacagagcaagactccatcaaaaaaaaaaaaaaatccctccattgtcagagtgtgagcttccagctcattatcccagaagcccgagatagcagcagttctcagatcttgtgataaaggtcatctcctatcctggggctctcaggaccataatgcaagagtctccctctaaacctgccagccccagggcttttcccgccttcctcatcctaagtcctgaaaagttcactgggccaaatggtgaaccacgcacttattgccccataacccttggtacaaatgtctccaaatatatccatcaagcctacaggtagtactgagaataacaacagtagctaacattgattggacacttctaagccccttaaatccattatcttacttaattctcacaacactgatcaagagttggataaaataatccactctcaagccagcaaatctaaaccagccactcttccgtatggattcctgctcttatggtaacaagggcttgccttccccacctttattcttaacccttctggaaaacctctgctcctccttttctgagatggaaaaatttataagtgaaaaaccattccatctttcgaggtgtggagggaggaaaacaatcactcctgccttcaactaagagtgtgaaaaataagcttaactaaacctgaaatacattttcaaatgcctttgaaaagacttataaatcaaatcacatttgtccatctctctgctcttcaaaattatcatgcatgcacctgaagtttaagcaaagaaatccattaaacaaacaaacctaaaatcataaaacccagatttagagatttatccgctcagtctaatgaatgcccaattcagaatacaattttgtcttcaaagagccctgaaggttcttatctttcttatctttctatagtgttaacagaaatattacatctttgaaaagaagaaaaacattattcccagagctaaaacagaaaaggctttgaactattttagggataaatcaactcacagttaccaataaaccaaaaagaataaaaaagactgtttcaaaccaagttgactactcttacatatattcaagtgtcaacttacaaatcagtctttaaatatacacgtacactttctaactctcctgaaatgtcacccaagcccccattcaatcagctaaaaacaatttaattctttctctagggaggaaatcaggttatcagataagtaaaccttaaataccatttctaggcctgatgtggtggctcatgcctgtaatcccagcactttgggaggctaaggcaggtggatcacttgaggtcaggagtttgagaacagcttggccacatggtgaaaccctatctctactaaaaatacaaaacttagccaggcatggtgacaggcacctgtaatcccaactactcaagataatctgcataccaattgtgggtagacataggtttttgtccagagccctccacagacccatcccttacctaccattgtctctcgggcttcaaccttatttgaaagtcttaatttgcagttccacatactgcaaacacaagacccagtctttctggttcttattttacctggagattaaaatacaggctgggcgtggtggctcatgcctgtaatcctagcactttgggaggccaaggtgggtggattgcttgaggccaggagtttaagaccagcctgggcaacatggtgaaacccctgtctctactaaaaatacaaaaatcatccgggtgtggtggtgtgtgccgacagtcccagctactcaggtagctgaggcataagaatcgcttgaaaccaggaggcagaggttgcagtgagctgaaatctcaccactgcactccagcctgggcaacaaggcaagactgtctccaaaaaaaaaattaagtttctgtcttacaatatcataagaaaatggctggacaggttttcaccaaagttggagggtacttttgtgatgggtttggtttaaattggtttaaaatataagacacatagtccatagagaattcacctatggactatgctgctaagagaatctcaaagagatgcactgttatgctccagagttttgtgagaggccactaaggtcaggagacacatgccatatatatcaagatgctgtcaacagagaaaaccagtgaggtttcaaacagaagccccgctccattcaaccaggcagccactcctcattgcaggtgctgacctgggctttggctgcttctcacatgggcaactctatacactctattcctgggagaagggcagcaaagacccacttattaaatgatgtttaacaatcctcggccgggcgcggtggctcacgcctataatcccagcactttgggaggccgaggtgggcggatcatgaggtcaggagatcgagaccatcctggctaacaaggtgaaaccctctctctactaaaaatacaaaaaaattagccgggcgtggtgtcgggcacctgtagtcccagctacccaggaggctgaggcaggagaatggtgtgaacctgggaggtggagtttgcagtgagccgagatcatgccactgcactccagcctgggtgacggccgtctcaaaaaaaaaaaaaaaatatcctccaggcaattgtgtgacagctggaatgaaaaatcaggggcaaattgtacatataagggaacaattgttcatatttgtgtaagctaccctccggagtctacaagttaaaaggcacactttaatcaatttggcaacttgcatggcattttcctccactatttgtaggatgctggtatctccttaacagctactgttttcctatgcaacacacaatgacttcttgaacacatggcagcttttcatttgttcatttaacaaatacttattgagttactactatgtgccaaacaccattataaaggtactgaggatacagcggtgaacaagatggacaaaaatccctgcctttgtactacattcttgagtgggtgtgaggagacaatgaaccaaagaatgaacaaactgtgtattgtgcaggtgtgtcatgggaaaaaaatgaaggagggaagaaaagcggaaaagcagaaaatgtcaggaatgcacttccgtggcgggtggccagacaggtggccaagaagtgacatttgaactaaagaaggtataagtgagcaagctatgagggaatttggcaaaacaatttcggaggcggaggtcacagccagcaggtgcaaaggcctggggcaggagtgggtccagggcatgggacggatggggagaaggtcagcatggctgaaggaagtagggggtaagctcaaacaagtcgcaggtgggaaactgagtgtattggaccttgtaggcaattttaagaactttagtttccactcattaacatggaaaaccactggaaggttttgagcaaaggaataacataatctgcctttttttcttcaaatgctgtgaaacaaatacttatttgaccctatcaccatttctacctttggaaaggctatggtgtgttactggatgttgaggatagcttactcttcaatgtgcagtaaccaaactgaattcattctttctcaagatgagagaaagataagccaggtatggtggctttcttagataagccaggtatggtggctcacgcctgtgagctgaggcgagaggatcacttgaggccaggagttgaagaccagcctgggcaacatagtgagacccctcatctcttaaaaatttttttttagttagccagacattgtggcatccgcctgtaatcccagctctttgggaagctgaagtgagctatgatcacgccactgcaccccagcctgggtgacagagtgagacccccatctctaattttgaaaaaaagactggatagggcctggttaatacaactaactccccaaaattcaagtttttcatataggtcttttttaaaaaatagctttaattgacataaaattcacccatttaaagtttacaattcaatggatttttatatattcacaatgtagtacaaccatcattataattttttttttttttttagacagagtctagctctattgtccagagctggagtgcagtggcgtgatctcagctcactgcaacctccatctcctgagttcaagcgatcctcccactttggcctcccaagtaactaggattacaggcatgtgccatcacgcctggctaagttttgtatttttagtagagatggggtttcaccacgttggccacgcttgtctcaaactcctggcttcaagtgatccacctgcctcgggtccaaagtgctgggattacaggcatgagccacagcacctgcccgtaatctacgttagaactttttatcatcccatcacccatttaagtctttacccattagccatcactccccattttctcaacccttcccgcaaaacccctacccagccttgggcaaccactaatctactttctatacatttgcctattctgaacatttcatatcaatggaatcatactacatgtgacattttgcatctggcttcttagaataagattttcaaggttcgtctatgttgtagcatatatcagcacttcagtccttttgagtttttttttaacaatctttaccattttcaagtgtatcgtttcatggcagtaagtatattcacactgttgtgtaaccatacccaccatccatctccagaactcttgtcacctctccaaactgaaactctgtacccattaaacaacaattcccattccccaccccaccccagtccctggtatggcaaccaccattgtactttctgtctctataaatatgactactcatacttcattttttaaattgccaagtaatgtttcattgtatggatatactgtacaacaatttaactatccattcagctaatggacatttggggtttttttaaccttttggctatcatgaataatgttctgatacttcgtgtgtgtgtatagatagatagataaattaaatagaagatagaagagagagagagagattggagacagggtctcactctgtcactcaggctggaatgcagtggcagggacacatctccctgcagcctcaacctcccaggctcaagtgatcctcccacctcagcctcccaagcagctgggactacacgcatgtgccaccacacctgactaatgtatgtatttacttatttatttatgtattgtaaagacagagtctagctatgttgcccaggctggtctcaaactcctgacctcaagtgatccttcctacctcagcctcccaaagtaccaagattacaggcatgagcccccgtgcccagcctgatacttttttttttaagtattattccagttgccttgttgaaaatagaccccaagaaagcaaatctcaaacagagaaaactgctaggaagttcttgctggaatccaggtgagaacggatagaggctcacatttaaatgaagtagtcagaaatagccacatttggatgtatttttatacaattcctgctcctgaagtcttccccactcctttttttttttttttaaccattactacaattgctttgctgcctttttgctgatttattggatcacgtgtttaaaaccctgatgtgaacacctacatttatccttcttactgggtatgtgttaggtatttaacaaagtcttagttctcctggagtctgcctgcatgaaccaaccaaatataaatctgcaaaatgggaactctacagtgtctcttcagttttgctgtcaagatttcacagcctcagcttctaaaattatttcatcaagttcaatggatacatattcttgaactcttttctagcctatattttccaacaatgttgctaactatatttccataccagccttcttatctaacatactggttaaaatgtcaaaaagcagagggtttaaaaagcttttctcggtggaatgtgcttctccttcatacatgatataacttgatttgaacaatgtcacaaagatattttctctgttagattaaaattttgtttgcatgaatttttcaatagctttaagcagttgaatagcaatatatgcaggaagaagctgagagacttatgtaatagatatttcatgtatctataacccacactgctgcccaggaaatgtgcgctgcattaatagagaggattttttcctgctgaataccttgaggagttggccaacacgtttgggagtagaagtagaaagggccaggtgtgatggctcatgcctgtaatcccagcactctgggaggccaagtggggaggattgcttaagcccaggactttgaggccagcctgggcaacagagtgagactccatctctaaagaaaaaaaatcataaaaaactaaaattctctgccaaaatggacacagaaaaaactgacaatccagagaaagataatatgcaatgaagctagacatggccaaattagaaaatgatattgagagagaacaagagcaagaaagaggagccctcagcattgagagggctgaggaagcacagaaatgactgatgggttggttagttagttactttttgtgaagtgtgcaatgtaaatttcactttggtctccccaccggaatcatcaactaaagtctacactgctatatcggctatctattgctgtgtaacaaattattccaaaactcagtggcttaaaacaacacatttattatctcacagtttctgtgggttaggaattcgaagatgggccccctgcttcagggtctcccatgggttgctatctaggtgtaagctaggtctcatctcaagactcaactggggcaggatccacttccaagtgcacccacatgattattggcaggattcgtttcccatgaactgttgtcagaagccgctttcagatccttgccacgtgggcctctccgaagggcagctcacaacacaacagcttgatttatcagagcaagcaggcaatgaggcagaacagggacctctcttagggacatgcagcactcccaccctcaaacatagaaataaagaaaaatcttaagttcctttaagaaaaattccaggcacttagctagcccttaaaaaataaataaggccgggcacgggggctcatgcctgtaatcctagcactttgggaagccgaggcagttggatcacttgaagtcaggagttcaagaacagcttggccaacatgacaaaaccccatctctactgaaaatacaaaattagccaggagtggtggcgcatgcctgtagtcccagctactcaggaggctgaagcaggagaattacttgaacccaggaggtggaggttgcagtgagccgagatcatgccattgcactccagcctgggcaatggagaaagactctgtctcagaaataaataaatacatcaataaacaacttaataagcaagaagataatagtagcttagaataatgggcaaaaaagttaaaatcatgggatgtttggcttccctataaaaactaatgttcatagattgtttttcaaaaatgaggactccccactaaatgggtccagcaacacacaaggtccagcaacacaactcagataagggggacctgaaggctaaactcttaacacttttctcagttctaaatttcttcctaaggggagtagaggaagtcacaccccaggccagaactaacattccactgatctcaaatttttagacaaggcttctcctcctaagccaattacaaatcaaaacatctttaaatctacctttgacccatgggttcccactttgagacgtcctgcctttttaggtcaaaccaatgtagagcctcccatatattgatttataactttgcatgtaacctctgccttcctgcaattacaaatccttacctataagccatccgggagcttgggacttaagcattaactaattatctttgcttggtgcccctccaataaataccccacttcctcttgctacaatcccaatatcaatgtttggttttgctgtgctgggcagggggacccaagttaggttcagtatcagcaagaaggcaagacagagtgtgtgctagcaagacagaagtccgtgtgtttggtaacctaatctcaaactgaaatgccatcacctttgctgtgttctactgattaaaagctagtcacccatatgttcattgcagcactattcacaaaagcaaagacattgaatcaacctaggtgcccatcaatggagaattggaaaaagaaaatgtggtacatatataccatggaatactacacatccataaaaaggaacaaaatcataccctttgcagctacatagatgcagctggcagccattttcctaggtgaattaacgtaggaatggaaaaccaaatactgcatgttctcatttataagcaagagctaaacgttgggtacacatggatataaacatatgaacaataaaaactggggactacagctgggcatggtggctcacacctataatcccagcactttgggaggccaagctgggcggatcacttgaggtcaggagttcaagaccagcctggccaacatggcaaaaccctgtctctactaaaaatacaaaaattagcagggcgtggtggcaagcacctgtaatcccagctactcaggaggctgaggcatgaggatcacttgaatttggaaggtggaggttgcagtgagccaagatcatgccactgcactccagcctgggcaacagagcaagactctgtctcaaaaaaaaaaaaaaaaaaaaaaaaaaaaaaaaaaacggggactgctagatgagagagaaagggagagacaaaagggctgacaaactatgctcactatttggatgacagaaccagtcataccccaaacatcagcaacagacaacatacccatgtaacaaacctgcacatgtatcccctacatctaaaataaaagttgaaattataggctgttcgcagtggctcatgccagtaaccccagcactttgggaggctggggcagaaggatcacttgagcctaggaaatcaagaccagcctgggcaacatagggagacttcctctctacaataaaattaaaaattagccaggcattgtgatgtgcacctgtggtcccaactacttggaaggctgaggtgggaggattgcttgagcccaggagttcaaggctgcagtgagccgtgattgtgtcactgtactcatcctgggccacagagcaagaccctgtctcaaaaaaagagacagctcactgtcagctcactgcaacccccacctcctggattcaagcgattctcctgcctcagcctcccaagtagctgggactacaagagcgcaccaccatacccagctaatttttgcattttttttttttagtagagacaaggtttcactatgttggccaggctggtcttgaactcctgacctcgtgatccgcccgcctcagcctcccatagtgctaggattacaggcgtgagccaccgtacctggccgagaaattattttttaagtgaaaataaaaaaataaaagctagtcactaggtccagcccacagtcagggcaaggggtcacaaaaggacgtgaatatgaggtggcagggatcatttggggtcatcttagaagctgtctaccacaatgttccactatgaattatttcagaggattcacacctggggcaaggaggtacatcgatagcatgcaaccagaaggagtcctgagacagtcatttgcagaaaccctggtgaagttttggttttccttggccatgcaatcaggggctactcactggctgatggactcagctgacacccagattaatttgagaactgtatccacagtcattaactacggggcagtgcccaactgtccccaagccagaagtaagaggtatgcatcttcacgacctcaatgacaaacttgatcatataaaataggcagcattaattgacctggttcaggctacgccggaggtggactaccacctggaaacagagagacattgcagaagcttccctgaggttccccttgcagccttcaggggtgaattctttgacactgggtgtttgaaatggagcaatcaaggccccagcaaaaaacagatgcacactccaatggggtaattgaggacagtttaggaaagagattatttacagaagtgtggacaggattaagagaaaacaaggatgtggagcacgctggtattatcaacagtggggtctaaaagggaaggagagagagagagagaatcctggaacccagagagagctgtcgctgtaagacagaactgcccaacaggaactgtggcctttagggagaaactgagctactgcaaactctcagcccggaaggaaagaagccaaaggaataaataccctgacctccccttccaccctccaatctcctactgggtccccactggccagtctggctccctgggcacaccagagttgagaagaacggacagcggatttggaggcgcaagaagaaagtatccaaaacctagacagaaagccaggcagcttcacatgagctttttaaaagtgtagaagtcataaaaattctcctggaaatgagcaaacacatgggctttcagaagatgaacacaaaatagcttttaaaatgaaagtctgctctggaagggaaaaggtggttcctggcaatgtgcagaggaggattaaagtccccaccctcaactccagcctgctgcgtcttccaagagagaattccccagagcctggactagggaagcattggcgccactgggaaaagctgctacagcccttgttgggcggctctttctcacagctactgaagctgcctttgcaaagattatgacagtgagagaatctggtgttgctgactccatcttgtttctagcctcacaggctaactgtcctcactcattcctgggcataggccaagttaatcatgagatgaatttttttattttatttatttgctttttgagacaaggcctcactctgtcgcccaggatggagtgcagtggcatgatcacggctcaccacagcctcgaactccctggtctcagggtggtcctcccacctcagcctccagagtagctaggactgcaggcgcatgttaatttttttgtattttttgtggagatggggcttcgccatgttgcccagtctggtcttgaactcctgggctcaagcgatctgcctgccttggcatcccaaagtgctgagattgcaggtgtgagctactgcacctggataggtatttagtttatagtttaatttgaaagcaaggatgataatagtgttccactaaaactgattccctcattgtttcagggctgaaaccacctttgtaaaactaaggaaaggccacaagattagggaggggcctgaattctgctaaaatggaggcatagtcttaggcatagttttagaaccagccattgttctataagtcacaagatttgtgacttccccaattgctcctatagataacatcactattatagaacctaggattggtcttttgagatgtttttcagactttgcattctggcaaataactgaccccacctggacttgtaactcatgactcaactggtcctgtggcccctacccagaggtggactcagagcaccaggaccatttcccacacctctattgcatccccaactaatcagcagcatccattgcctagtcctctgcccaccaaactatttttgaaaaaccacaggctgggtgcggtggctcatacctgtaatctcagcactttgggaggccaaggtgaggggatcacctgaggtcaggagttcgagaccagcctgaccaacatggagaaaacctgtctctaccgaaaatacaaaattagccgggcatggtggcacatgcctgtaatcccagctacttgggaggctgaagcaggagaatcacttgaacccggggggcggaggttgtggtgagccaagagcacaccattgcacaccagcccaggcaacaagagcaaaactccacctcaaaaagaaaagaaaagaaaaaccacaacctccaagtttttggggagactgatttgagtgataactccagttcttccacatggccagcctcaagttaattaaactctttcttcactgcaataccacagtctcagcaaactggttttgtctatgcagtgggtaggaaggttgagtaatcacactacagttctttctggattccaggagtctctctccccttcccttttagacctggttggtaagggctctgtgctgttgacagttccagagtacctcacatcctttgtttcatttaacccagtccatgcttctgtaaatactctctttgctaaactctcctcaagtaattgattttaatgtgcatccattgcctgccaggacctgattagtccatttcaagcatccaatatcaaagaatgcacccaaaacaaagacgctgttaggaaacacagaactgggcactgcaaaggtctttgagcatgacacaaggatgttgcaagagcggcaggcccagaaggcaagtggggattgaagaaccttaacagcatattcacggggctcagtcctaggattcagcatcatgacatatcacctccaagcttccatgctttcatttgtatagctaagacttgacaagactagtgagggtgtccgatgatgaggacagtcaaggatgttaaattcctgactatacattaacaaggaggaaaaaaactaacaaacctgcatcagtgtgaagaccagaaaggcctgtccacagagccagatgacaaggtacaacaggatgctgttgaaaaaaatcagactagataagagcaggttgctgtgtgagcaaactcagaccatacaagagaactataggcccctctcctccagcccagaattcctgccctgagtgatgctaaatcagaaggaagaaaagcaggagatgatattggctaccctccggggacaggaagcatcacctggttggactaccagactgccattcacacttatatacatggagtcagtcgggtatgactcagtcccctgaggccaaatgtcagcgaggagagtgggaggagcaaatctctctcctccattagagttgtctccggaacaaacccaggtctcaaggcaaaggcctcacacactattttgctattttgtcacccacgtaaagttttcagaaacaggatccctgtagctcatcaggcactcaggtgcatcaaagctgaattcagggtaaagattgatgctgtggcccagtgaagctgagatgcccatactctctctgttcaggttatagagaaaatgggcactttgtgatcacttatacccataataaaaaacaatttgtgtgcatctcatgagcaagaaaaataaacaggaaaaaagaaagcaacccaactacttgtaagtataaggaaatccaacccatatttgttcatataactgaaaggtccaggggcaaacctgcaggtatggtttgatgcaggtgccaacatcttttgccaggacccagtgtttctcacaccctttcttttttctttttttctttccttctttctttctttttctttttgtctttccttctttctcttttttttttttaacaggatctcactctgtcacccaagctggagtgcaatggtgcaatctcagctcactatagcctcaacctcccaggctcaagcaatcctcccacctcagcctcctgagtggctaggaccacaggcatgcaccacaatgcccagctaattcttttcattatttatagaaacagggagtctcactatgttgccagggctggtctcgaactcctgggctcatgtaatcctcccacccacctaagcctcccaaagttctgggattacaggtgtcagccaccatgcctgacctcacaccatttcttaactccattcttctcactccatttcttaatttcattcctttataaagcttctcttcttactatttcaagatggctgcccaattcatgtgcagaggaaagagaagttctttctctttactctgacagttgaataaaaaatccaaagcctggctctctttggtccatccctgaatcagtcattatggcctggggaatggagtatgctaattgacttaagggaatcagggcccagcactggagtgaaggtggggctaatgccacctaatccactggagagtaccaaaagtgtgcttccccaaaggaaattcacaatactgtgggaaaggatgaattgatgctgagtcactatgaatgacaaatgcaaaagataaacataccaggccccactccttgcaggaagcaaaagatcctagagggagaggctgacatggaacaggatgtctgaccaataaaacttcttccaatgaggattcacagacatagtcataccttccaggttaagtaaggctcaattccaggcagctgtctgtctcagctcctcatgcacatccgtcgcttctgtctacccagcatttgtttctcccttattcagttctcattgctgtgtaacaaattgacagaagtgcatcaactaaagcaacacaaatgtattatctcacagctctataggtcaaaatccaagcacggctcaaccggattctctgctcagggtctcatggggctgaaatcaaggtgtcagctggagctgtagtcttatctaaagctcagggtcttcttccaggatgattggttgttttcagacttccgctccttctgattatcttgagataggaggcaggacttgactctggaggtggggcttggacaccggaccaagttcaggactaactaaaacagagctgggagggaagcagctttccctaagacacacccaccagtgtgccaggtcagtttaccattgacacggcaatacctgggagttaccacccctttccatggcaatgacctgatgacctaaagttactaccccttctctagaaagttctgcagaaaccacccttgaatctgcatataattaaaagcaggtataaatatgactgcaaaactgcccagagatgccactctctggttacagggtagccctgctctgcaggagccgtcatggagctgtaacactgcaggagctgtaacaccaccgcttcagtaaagctgttttcttctacctccagcttgcccttgaattctttcctgggcaaggccaagaaccctcacaggctaagccccagtttggagttcatctaccctgcatcaatatgactgaggtcttttttcttgctggctatcgaccagagacctctctcacctcctaaagacaaacctaggtccttgccctgtggcctctccataggctttctcacactttgagcatctctgacttcaggaagggcctagtcccttttaaaggtgcacctgattaggtcaggcccacccagatgctctcccttttgattaactcaaaatcaactaactagtagcccagtcagggcagggctattccatcacatcctctaattgtgcagcactggagaggaggagattgcacagattgtgcacaccagggagcagggatcttgggggccatctcagaattctgcctaccacatgttagtaattgatctcttctggaatcagtcctttcctgctcagtcaatgttatttgtggtaggatttagggtaatcagacctagccttggccaattggtgtaaccattgtctgggccacagtggtcagatcagaaatgggcacctgcctcaagcaagcccaatcagacctaacctggggacttttgctgaagtaactaggaaagatctctctctctctctctctctctctctctctctctctctctttcttgttattgcggaagtgttaggctgtaaacttagagctgatggtggacaccatgtgctttgattcaaatgaccccccaaaactcatgttgaaactgaatcccaaaagtgggagcattgagaggtgggacctttaagaagcgattgtatccctcttgagggcagagcctttactgaccacctaatgttttattaaagcttgtctgcaccacccctatccctaccatcaccatctggagctctcgatcctttcctccagatttctttgctccataatatttatcactatctgatacaggggtgtgtggatgtgaacatgtatatgtgtgcatgtgtgtgtttatggtccgcctctcccagtccccggtagactgtaagcttcatgaaagcagggctttgtgtactgttgtttctgtagcatgaggtctgccaaaaaagtaggttccccataaatgtttgttaaatgaatatattctgattctatctccccctcctccagaatggatctaaagcttcccaatctttgcctgagtgagtgtcctactgagttcaattttgtttcagaaaggacgtgtgtatgttcacccatatgctgcacaaatatgtaatggacaccagccatgaccagcctactggggactgcttggcagtagcaacatggcagcgaacaagacagatgagcctcctgcccacagaagcttacattcgggtggaatacaggctggtgagttgtcatgccgattcctccaacccaaaacccttgccagtatggcaggtcctggagctggactggccaccattgagaatccacccaactgcccatcagcatctcaagttccctgttgcaagatgccagggagcatgagagaggaccgtgggggagagtgagctctcaatgaacctggtgtggcagggagaagacgaagatggggcagatccccagggggaagacaacttaagggcagatttgttgaactaagttacttcaaagggtcttccatcttccagcatgagcagagaagatgaccacacacctgggggagagtcagatggcttcttcaattggaacgttcttccctaaggatgagctaatatagcacatgacctgaaaatccttctgggagactccaggtaaaagggccttgactgcaccagggagagaagctaagttgtagatttgggggaaatgagtgttagaacagtgagtgctcaagggaagtagttaagtgagccatgagatacaaagtctgccatggcaaagtaggtggaacaaccatgttatgagtataagttctgaccccagctttcctgtgatttctacgacccttggtcttgaagatgggaaataaatgggtgcatgacagaagttaaagactattatcgggtatcaagtaccatagcactttttggaggcagaagagcttgacaaatgggcatagtgtacatagtaaatgatggtaagggtaaaggataaaatgtatcatcttcctgtcatcagaatgggaccagcactgtgtaaggtgggcatgttaatgacatgatatataagacagcttttgctacaataacaaggaactccctaggcctggcacggtggctcatgcctataaccccagcactttgggaggctaaggcgggtggattacctgaggtcaggagtttgagaccagcctggccatcatggcgaaaccctgtctctaccaaaaaatacaaaaattagccaagcaaggtggcactgcctgtaatcccagatactcgggaggctgaggcactagtggtgcttgaacccaggaggcagaggttgcagtgagccgagatcactccactgcactccagcctgggtgacaaagtgagactccatctcaaaaaataacaataacttaaaaaaagagaaatagctctcaaatcccaatagatccctataacaaatatttgtttcttgcttctgagtcttcagattggctgtgattacactgggtttggcttggctgagctcagctaggttctgctgagctcagcttggctccaaggtttgggttgagttcaggtctgctccacatgtcccttcacatgagaagcaattgccaagaggtcaagtcaaatcatgcagcacatttaaaacttctgctgggggaaaatgtgtctgctcacattccaatgaccaaagcccaaagttagaagggcaaggaattagactctacctattgagatgtactacaaagtcacatggcaaaaagcttataattctaataaaggaactaagcagaatcactaggagcaatcacctagtccgccacacatggagatgtgccacagggactcagagactggaaggaattccccagggccagagttctcctgggaaactacagcctccaccattgcctcccagatttcatcagcatctctgtagtctggctcatcagaggccacaacggagataaaggcaaataaagacttcagctgctggcaagctgcagatatctccatggatcagccaagcccatgtctctttctgaaacaatcagtaatcggggaagcgaccacagaaaagcgtaatacaaactacctatggtattggaagaatcccaggaatcgttggaggtcttgaatgaatttgaagagggtactcagttcaagactactttaagacacacactttgtagatgtcccaactagatactgtgtggcctgggaattctgcaatgtttactttttttcaattatattatgttataatatatttataagaaatatatatcatatataagattatatatagcttatatatctatatataatctagatatattatatatctaaatataatctttgatatatatctcatatattatcttatacatatgatatattatcatatacatgagttatacgtatctcatatatattattttcttatatatatgaaatatatctcatatatataagatatgagagctatatatctcatatatagatagatatagatatctatctacatctatattcccaggccacacagtgtctagttgggacatctacaaaatgtgtgtcttaaactagtcttgaacgagtaccctcttcaaattcattcaagacctccaacgattcctgggattcttccaataccataggtagtttgtattacgcttttctgtatatgagatatatatctcatacacagatagatatagatcattccatcacccaggctggagtgcagtggcacaatcatagttcattgcagcctcaaaattctgggctcaaccgatcctcccacttcagcctcctgagtggctgggactacaggtgtgtgccaccaggcgggggctaatttttctttttttggagacagagtctcactctgttgcccagactcagatgtagtggtgcaatctcagctcactgcaacctccacctcccaggttcaagcagttctcctgcttagcctcccaagtagctgggactacaggcacgtgcaaccactcccagctaattttttgtattttactagagacgaggtttcaccatgttgcccaggctggtcttgaactcctgagctcagatacctgcccgcctcagcctcctaaaatactgggattacaggagtgacccacccactgcccccagcctttttttttttttttttttttttttttttttttggtagggacaggatttccctatgttgcccatgctggacatgaactcctggcctcaagtgatcctcctgcctcagcctcccaaagtgctaagattataggtatgagccaccacgcctggcccaatatttctaaaggcccctcaagaggcaaaagtgggcaaaggacttttaaggacaaaaaatgcctagtattgaatattaagttgtttactgtgttgtaactctcttccatgacttcagtaaagcagagtaagcacacacatgccccaagacacagtaacctctgtttggtagtacagcccatcacaagcagctgtggctgaacccctgggtaccaggactagagaggataacttcattgtaagttccactggatgttaggctgaagttgcagcccccatcaagccaggcttggtgtctggagcgggcctgaaggtagagattctgcaaaaggatctaactggggtgatattcaaaaaatttagaagccagaatggcacaggtcctgactgataagaaccagagccaacatgctgtgatctgcatacaagtgccagtgatccctgcctccagctgaggagggctgtgaaggatggaggctagaaatccatcaggagagctgacattgaaaggtgaatgggagcagcacctgccagcgtgacctgctgctttcctgcatgcaaaggactgtgcatttcaacctgagaccctggggttcctgcagggcatcagctagatttgtcttcctgcctggggcgatcaccaattatatgtgctgtgaggcaaactgtcctcccaccagaggaggaggtgaagggatttacagaatctctctctgatctgacttattagagaagttaaaggacacctgtccaggaggcagcacagtgcagagataaagaagtcaggattcaaatttgtcctatctgggaagcttagacaagagctccttaacctctctcacactcagtcccctcatctggaaaatgggaatcctaacagtgcctacctggcaggagcatggccacaatgaaatgagctaatgacacagtgaaagcccttagacagcctgacccagagtcagccctctgtaatgggagtcattattcaagatgggaggaaagaaacaggaattagatcagaaacaaatgaccagaaagagagatgaaatacaaaagctacatgaagtcggcagtgtgaagcctgactcgcaggagagtggattttgttactgtttgctttttcttgtccaggataatccaagactggcagaaagtgagaataccgattgagatccaaggacatcctcatgggagtctgtgcagacacgttttcatcaagaacccctctccaagcagctggtccagcccagctaaactgggggctgctgtttgtaagaaaattaatgctctgggccaagcacggtggctcatgcctgtaatctcagcactttaggaggccaaggcaggcggatcacttgaggccaggagttcaagaccagcctggccaacgtggtgaaatcccgtctccaccaaaaatgcaaaacttagctgggcatggtggcgcatgcctgtaatcccagctactcaggaggctgaggcaggagaatcacttgaacccgggaggtggatgttgcagcgaaccaagatcatgccactgcactccagcctgggtgacagagtgaggctccatctcaaaaacaaaaacaaaaaaaattaatgttctgtacctgaggagcacccatttgctgctacttccctgccaggatgaaggaaaaccaagtcagacattaaataacacgtgcaggatcacaggatcacacctttcacactgcagtcttagttttctataaaaccacgtgacctctgaaaatacactccagcctctgcaacacctactcatgacgctttgtaaaatccaccgccttttagggacaccaagattttcggaaacatgcagttttcttacctccagatgagatgtctactgtggataggtgactaggaggagaacccaaggtgtgctgatggcagaacagaagcacctaggatgccaccagggaaacgccctgacaagcagctgtgatgctgtcttcgagaaggtgtttgcaaacaccactgctgccccccttccctgagccctgacttcctaaacctaaggctaaaagcatcctggcaattcccggaagtaacttcattctagcaggatcgagccagtgggtggagttttctcagcccgccaggatcacatcagtgactgacttacccaatgtacttttattttttatttcaaccaattccccaaagcccagagcaacttaaaaccagaagagccaccaccatctccaccaaaaacagggaatattttgagagtttaatgataacttcacagccatccattcagctgagtcccaaggaaatggaagacacctgaaaaatgtatttttaaattgatttaacgttgagccatgttaaatgttttaacttccaaccaatgcaatgcccaccaaaacatcaattagtcccagcaatcaggcaagaatattggcttctgctcagggattcatttatttcagctctgctaaatatcgtagaggagaaatccaatgtagcctgtagcttcaagaaagtgaaattaagcccaagtagaaactagatgaggccctggctaaaatggtgccttttcttgcactgcctctctctggtatctctctaaagtgagggcagcaacttgattgtaagggtctcgtgctgttaacagaaaacacccttccttccccacaggttctctgtctccaagctggaaaacaaaagaggctgcaatgggacagagaagggcttcctgctgaggagatgagtgggcttaagaatttgcaagatcaaaaatcaaaacaattaaacccatggagatagagtagaaggagagtgaacagaggctgggaagggtaatgggagagttggtggggaggaggcagatggttaacgggtacaaaaaaaacagaaagatgagtaagacctacttttccatagcacaacaggatgactatagtcaacagtaattttttttttttttgagataacgtcactctgtcacccaggctagagagcagtggcatggtctctgcccactgcaacttctggctcctcagttcaagcgattctcctgcctcagcctcccgagtagctggaattacaggcgcacaccaccatgtccagctaatttttgtatttttatagagatggggtttcaccatgttggccaggctggtcttgaactcctgacctcaggtgatccacctgcttcggcctcccacagtgctgggattacaggcatgagccactgcacccgaccctatagtcaataataatttaatcgcacattttaaaataactaaaagagtacaattggattgtttgtaacacaaaggataaaggtttgaggtaatggataccccattttacatgatgtgattattacacatcgcatgcctgtatcaaaacatctcatgtaccccataaatatatatacctactatgtactaatgaaaattaaaatttaaaaaaattaaaaataatttgcaagatcatttttaataattatttttcatttggggtgcattttcaccatcaaggccccagggtttccctgccctagatgagggtctggatccagggaagggtgtcccaccatctggagcatcctgtctctacacatgttggccagctgcttggggcaacacaggacgatgcgctcaggccactcaccacaggagcttggccattagaaccagcaggggacaaccaagccaaagaccccacgactggagagctcctaaaagcaaatacaaaataagagtacacatgaagttctggcagcaagcagaaggtagacacatgatgtccaactccccgagtctctctctggggccacttgatgcagagccttgatttgttcgtctcttaaatgggaacaatgatccccaaagaggaggaggggtgggggagtgagaattaaatgagattgtgtcagtcagcatgtactagggagcttgttagaaacaccaattccaggatcccctggagattctgatttagcaagtctgccaggagacccaggaatttgtattttaagcatctctcccaggtgattctgataattaagcaactttaggaaagaaaagattagggctctggtccataggaagggttcatccaatggcagccctcacttaggcccttggggtgaatgaaggaggggcatccaggatcttgcccagccagggacatgcaggaaacatctttttaaggggccctcatcactttctgacactgctgtttcaagggaaaactggtcacacctttctgcaggggatttgacaacatccattaaaaaaaaaaatttaagacagagtctcgccctgtcacccaggatggagtgcaatggcgccatctcggctcactgtagcctctgtctcccaggttcaagcgattcctctgcctcagcttccctagtaactgggactaaggcatgtgccaccacacctggctaatttttgcatttttagtagagacggggtttcaccatattggccaggctcatctcaaatttctaaccccaagtgatccacctgcctcagcctcccaaagtgctgggattacaggcataagctgccacatccgaccaacatccatcaaaattataaatgcagaccctgtgatctagcaatctcactttgaagagtttatcctacagacatacttgcacagatgcaaattatatcaggtcaggagctgcagcattgttcataacagcaaaaaaaaaaaaaaaatagaaacaactgcaaggtccatctacagacctctggttgaatacagttacggcatagccataaaaccaacaatggcacagctcctgtgcacagatacagaactccctccaaagtatattgttaggtgaaaaatacaaggtgcagaataaggtgtataataagcttttgtgaaaagtgcagagatcatctatatttgatttgctgtgtatgcatagaatatctctggacaaatacacaagaagctgctaacattggttgcctctggggagggaacagggtggctgggggacaggggctggaggaaaagatttcaccacatgccttgcagactttatatattcggaaccctgtgcattatctattgcacatattatctattcatgcaaaacgctataacatttacaaataactttcaaatatatgcatatcatatttcaatggaaagttttttttgttgctgtttgtttgtttgtgatggagttttgctcttttgcccaggctggagtgaactggcatgatctcagctcactgcaacctctgcccccagtgttcaagcaactctcctgccttagcctcccgaatagctgggattacaggtgccccccaccacacccggctaatttttgtatttttagtagagacggggttttgccatgttggccaggctggtctcaaaactcctgacctcaggtgatccgcccacctcggcctcccaaagtgctaggattacaggcatgagccaatgtgcccagcctcaatgaaaagtgttttaaagtaataatataatacatcaaaaggcatgatttatgttttcaagtgccacctctggccacttgtggctgtagaaatggggaatactccaattcaccatccctatgtgaaggcaggacagggagacattcaagtcaggaaaaggtggagtggaggttttagtcaagcaccaagtcctctgacttctctgggcacttgcccatgccggtacctactcctgagacactgtctacctcgctaagcccatcttcttctcaccttgtgtctcacctgagacatcactgactttaggaggtttcctgacccatgtgtgttccccatctcagcacccagcacctgcctcatgttcaccagggtacatgtcttccctccccgccaggctgcactgagagctcaatgagggcagggaacatctctgttccccatcttgttagaagctatctccccagagcatggtccaaatgtggtgttaagaacagaagttatcacaaagaagtgagaaagtgaaggggaaatggggagagctgtaagaaaggcatgggggagaaaaaggaaagaaggccatgttcccaggatccaatgccactccctggggaggcttctctatcttagctcagccctcagtcactatcaccctccctggtcttgtcagatttgaaatatcttcttcatttacaagagggccttatctatcttggtcacctctgtattcccagcccctactgcggacttggaacatagtaggtgcccagtaaacatgggttgaattaattaatattggacaggccaggcttggtggctcgcgcctgtaatcccaacactttgggaggctgaggtgggcagatgacctgaggtcaggagttcaagaccagcttggccaacatggtgaagccccatctctactaaaaatacaaaaattaaccaggtgtggtggcacacacctgtgatcctagctactgggaggctgaggtgggaggatcgcttgagcctgggaggtggaggttgcagtgagccgagatcgcggcactgcactccagcctgggcgacagggcgagactctgagtcaaaataataataataataatagttcattattattggatagtgaggagggagtttgcaaaggagcggctaaaatgaaattagtcctgagtttctgatgttatgcgttctgggtaggggcgggagaactggaagatgtttaatgccccccacccaagggcagccatagttgagaatcactaattctgaagcttggtagggaagcttgatagggactttgggtttttcactgagggcagaatccccagtgactgtcagagacctcgctctgaatcttaagaacctccccaccccaggcctgacagggaggacaaggaaggagagtggggctgggacgcggggcagagggcggctctgctcacctgcgggagaacgcgaggatgaggttctagtgggaccggcgctagcgggcgcgtcctgccaggagtgagtcttggcgccatctagcgcctgctggaggctctgcagctgcagtggactgagccgccggcgctgggcgtgggtcaccgccgcggcgttctccggacccagggaggcgatctgctccgcggacagctcctgcaggaggcaaaggggcagcaccctcacacggggcccctccccggatttcccacatctcgggcgtccgcgcaggatgcacacaactttgccatccccttgtgtgtatcatgtgtggtcctctttaagatatttccttaaaattagatcactcttgcactaccaaagtaaatgcatttaaaaatagaaaatttaaaatggaagtttccaaaaatggaaagccggcagacttgccataagcaagcattaaataggagccgcaaaataaaaataaaacaatattgttgaatcctagctagatttgtccgccaacaatatctgaacccctggcctcttggaaaaaaaagagagagagagagaatataaaatgtactatacagggttaaattgacacttccttcttgaagtatttagaagtactaatggagagttgaaaagggaagcatgatttcctccctatgtggcaatgttgtttaatgcaatgcaggacagcttcccagtgcttcaagtcttccacctcctgaaacactgatgtggagggggaaacacaggccttaaagatcagaggcctgaattcgagcccctgctctgccacatacttgctgtgtcaccttgaacaaattacacagcctccgtgggctttggggataaatgtgagacggcatagagaactcatctcctctgctgactgattctgatcctttggtttgactgcctgagcaccatgtgatgagctctgtgagggctccatggagggaaaatgcagtcatctattggtgatatctgctatggacaacatgagttggaaattctgccagccagactatgtcttcaaggactgtgaacaaggtgtcttctgaagtcacttccagatcaaaggacttggtgactcgttccaatgggactggaatacgaaggggactctatatcatcatgtttattttctaaaggccctgaagaatctgggaaagatgcttatgctccctcatcccttcctctcctgtcagtcaccctctcctcctcttttgtccaggtagatacttccctggaatcatatccctctgtgtaaagcccttccaggaaccccactccagaacacagttcaggctcctggaaaaaactctgcccacctctccagcctcacacatggcattcttcactccaggagagtgggtgccaatatttacagttccctagaggcagcatcttcctgtgcacctctttctgcctggaacactgtttcttcttcatcgccagctgttctccaagattcagcatctggtcggtcaagcgccatggctcatgcctacaatcccagcactttaggaggctgaggcagaatgattaacggagctcaggagttcgagaccagcctgggcaacacagtgagaccccccttctctacaaaaagtttttttaattagccaagtgtgtagtcctagttacttaggctgacgtgagaggattgcttgagcccaggggatcaagggtgcagtgagccatcattgtgccactgcactcccttgggcaacagagtgagactttgtctcaaaaaaattaaaattcagcatcacctcctctcctctcactacacacacacacacacacacacacacacacacacacacacggtggggtggtcagagaggtacttttttggcttccatataccattaacacagagtctgtattctaaaaattatctcttttatcaatgttgctgacttgcgacccacaggccagattgaatctctaggcctacggcactgtgttttcaaaaataaattcagattggctgccaacatttaattatcaagcaattccatatgaaaatgaagatttctgacttcttctcgaaaaaagtgaaaaggaaaattcagcaatcttgggcccacatggccacactgcatgaatgtgctaggaatgagaagcagcctccacatttagacaaggctctccagttcacttcggtctctacccagcctactgcaccttatgttaccttttaggcccctgaaggcactatgtgataaccccttcacctgtgcatccttaggtgcacctaccctggagcctgccacaatgtaggtgatcagtagggatttctggaatagataaatacctgtacaaggaagcagcacaacagcactccaaacaagaccaagagaaagtgcttagcaaaatgccagcatccaagaccaagctgcttgtcccatgcagagtgccccagaggggaagcaggtatttgctcaatggctttgaggactgctatttattgccctcaaacagctattatgcctgcaatgtgctcggaactgtccaggatgctgaagtgattgaaggttggctttctttttttttttttgagacagagtctcgctctgtcgcccaggctagagtgtagtggagcgatcttggctcactgcaagctccgccccccgggttcacaccattctcctgcctcagccttctgagtagctgggactacaggcacatgtgaccaccccagctaatttttttgtatttttagtagagacagggttttaccatgttagccacgatggtctcaatctcctgacctggtgatccaccctcctcggcctcccaaagtgctgggattacaggtgtgagccactgcacccggcctcagctatctttcttgaaatgaacaagtgatgtggcactgggggagtttgtcgagcctggtttgtgtgttttatccagaagtgctggacaaaatgtgttcccacattacgcagcaaacaggaacaccagaatgactgcctcctcatcagagcagactattcccaccaaacactcccctaatcttgtatacagacagaaaaaaaggacctgtcattagataccctgcttcccttccttcaaatgatccaatttcaccctctcaattttttcatagcagtttttcacctgtcctcttgtgattttcctaatacttttctttaaatcaactaaaaatatatatatatagaaaaaaatatatatatatagagagagagagatggtttcgctcttgttgcccaggctggagtgcaatggtgtggtcttggctcattgcaacctctgtctcccgggttcaagtgattctcctgcctcagcctcccaagtaactgggattacaggcatccaccaccacgcccagctaattttgtatttttcatagagatggggtttcaccacattggccaggctggtctcagactcctgacctcaggtgattggcctgtctcagcctcccaaaatgttgggattacaggtgtgagccaccatgcctgacctaaatcaactaaaatatttttatttaattatatcttaaaaggaaatgttacagaggtccacaatccctcatctgcaattccaaagtccaaaaataatctgaaaactgcaagttttcccccaaagtttaagtcaaacttatttatcagcaaaacttgacctgaagtaatgtgaggctatttatttatagtctctatttattccaattagtgtggcttgtcacagatttcttcacagaaatattaatgtgtttgcttacaaggtgcttccccagacactgctgggggtatgaagttacatacagtaaatgtacagggtgatcttttcaaaatctgagaaattctgaattctgaactatatctgtccccaggggttttcgtaagggtttatgaacctgtcataccaccataagtagaaaatcagtaccacctgctagaagaagagaagatgaccgtaaaaataaatataattaaactacatattgtaattttaagaaaaatgttttttaaaaacacctaaactcacacagatctcctctgaccccatcagcagagcctggtcacaagcctctaaattccaaggcccatcacctgtttccctgtgtgatttgaaatggggtcaagctcccatttctccttgaagaactgagcacctactttgaatatctcatcaggaaggcattttattgctgatggctggaaatatggcatcaaatccttgtcaagcatccggagctctgccttagttaatccagctggggagaaaaaggaatcacgggggtttagttcaagccatcagaactccgcttgttttattaatggtgctgcataatgttcagatctgagtgttctaggcaggcatcattccttacaaaaggccctggaaatcacactggggaatcaagttccttcatcaactcagaaaaaaaaaatgtgggtcacattagccctgattggcctcctacagtgaaacgcatgcccagaaggaacttcaatttacacactttcaaattttgtataaacctacttaggggccaattaaatcacattctaaactagcggttttccaaactttagtgtacacaagaatctccaaaagagcttgttttaaaagcagatttgcagacccaccctctgcaacttcaaatcatgaaatgtaggttctactgtaacgccactgatgtttgctacacatggccaaggataatgttttattttgtgtccccacatttaagtttggaaagagagagaaaggtatgctcagggtgagtcttacctgcaatggtcccaagctcctgcaagacagaactggtccactcagtgggatccccaaacacaacttcagccttcctcttaaactcggctaagacatgtgtgctgcagagcagggtcccaattctggccactaccaccctggtagtggttaaagagggagggatataatatgagcttggactcttcagccaaaaacaaacaaacacacacacacacacacacacatacacacacacactgcacagtaggctcagcagggacagcagatccagcttatcccattagcccagtgggattttagcccagaaaggtgccaagtgtcaggaggtggaatatctggatggatggatggatggatggatggatggatggatggatggatggatgaattaacccatttgccattttgcacattcatattttagttacctgaattctgagatctttataagtgggatttcagtgatgtttatagcacacagggttgcaccaagtcctaccaaatgaaagctcttcaggtcctggatactgtatcctgaatcatccaggtacccttgcaaaatggattcagcctaaaaaatagtaagaataaaagataaaccatccaggaatgatcaaggtccccaggcctgaggggataaataagctgttgctgtagtctcctgactgatctcccatcctactcctctggaatccccactccaaaccatcctggcctctgcatccaagttcatgtccttaagatactacttcaactgagtatgtcccctaatctatgaaagtgtcttcaggcaatgaatctcttacatccttcaccaatattaaaggcacttgtgtcctgtgtgtctgctgcttatttccttcagtcactcttatgaccctcagacagtttggacatacaacttcttctgcatcaggatccaaacttttccagcatctttttccacaacgtttcttctcccttttttttttttttttcgttttttggagacggagtcttgctctgtcacccaggctggagtgcagtggcacagctcgctgcaacctccacctccccaggttcaagcaattctcgtgctttagccacccaagtagctagaattacaggtgcacatcaccacatctggctttttgtattttttgtagagacggggtttcaccatgttgcccaggctggtatcaaactcctgacctcaagtgatccacccacctcggcctcccaaagtgctgggattataggcatgagccaccgcacccagcctttccacaacctccaacaaaaccttataatttcctgtctctttgcctttgttcaaaccagtcctttcatctgaaatgcccttctgcacttccaagtgcagacattcttttttttttttctttggttcaactcaaatgtcaccttcttcatgaggtttcagccagaatgattttttcttcctctatggtcctacagaaatatgtttaccccttaatgattttttcttcctctgtggtcctacagaaatatgttcaccccttcaattccaatgtttactcttcaattccaagagtagcacacaaaatgctttggtgttaaactattttaaactaagccttgatttaaggcggctgacacataagtctccataattctagcacagtggctattcatcattcataacttcctctggagaaccacctctcttgtattcctgcttcatgtggttcagtcaaagctaactgcaccaagttccaggagtgatgaatttcaattcataccttagcctagctgcagtcactggttctggattggacatgtgatttaaccagagtcaaccagaactttgagtggagcattaggggaagagctttctttactctggacttgaacttagaaggatatacacaaggatctgctggaacctaccacatgcaggcatagagcctgtctctcaatgaagccaacacaaagaaaagcaaagttcaaaaacatgataagagacagattcccacccagagtgttgaagatcctggatccagctgtatctgaacactacccctgaactttccagtaatgggagtcaataaattcctttttttttttttttttttgagacaaggtctcactctgtcacccagcctggagtgcagcggcatgatctctgctcactacaacctccctctcccaggttcaagcgattctcatgcctcagcctccccagtagctgggattacaggcaggcatgaacatgcctggctgatttttgtatttttagtagagaagtagtttcactgttgggccaggctggtctcaaactcctgacctcaagtgatctgcccgtttcagcctcccaaagttctaggactacaggtatgagccactgcacagtgcacccagcccctttatttgttcaagccagtttgtgttgggttttctgccacttgtaactaaacatgtgctgattcattttatctacctatgtaggacctgaggaggcatccaagccaatcctatgaagatcagctacaaaataaagtctgggctgggcacggtggctcacacctgtaatcccagcactttgggaggccgaagcaggaggatcacttaaagtcaggagtttgagaccagcctggctgacatggtgaaagcttgtctctaccaaaaaatacaaaaattagccaggcatggtggcacgtgcctgtggtcccagctacttgggaggctgaggtgggaggattgcttgagcctgggaggtggaagttgcagtgatccaagattgtgccactgcactccagcctgggtgacagagggagactctgtctcacaaaataaagtctggttccttcagtgctcatgggagcaagtaaaagagattataagacctcacaaggcaaagatgaggagacatccaaggagagacccctaagtggaagcgaaaatcacaggctatagtcaatcttcccaactctctttgcttttttttgttttttttttttgagacagcgtctcactgtgtcacccaggctggagtgcagtgacatgatcttggcttactgcaacctccatcccccagggttcaagtaattcttatgcctctgactcccaagtagctgggattacaggcgcccgccaccacacccaactaattttttgtgtttttagtagagacagggtttcaccattttggccaggctggtctcaaactcctggcctcaagtgatctacccacctcagcctcccaaagtgctgggatcacaggcatgagccaccatgcccgacccccatctccgtttaatgttagtcatccccatcacacaatatagatcattaaggtgttgagagaaagtgttgaggaagattgtgaaatgttgcaatgaaattccgtcttcatgggctggtgcttcccacccctcaggtgtgtttaaatgctacctactcagagaaaactgccctctggactctttcatctcaaacagcccttcttcccactattcccatgagcaccttgtccattttccgcatcacttatcgtgatttttcaaatttttcactttgattactcacttttttgtctgtatcaccaagtaggctcccaaaagaaaaggaccatatccaggtagtttaccaatgagtccccagcacctagcataatgcctgccacagagtaggagttcaataagtacttcttgagtaagtaaatgaatgagtgaatgaatgaatgaatgaaacaacatctgagtgagtgacttacaaaagtcgtgggcaatatatattatttgacatgcttcattttgctgccttcatgtaatagactggcttcaggaagatttctcatgtttctgaaaatcggactggtcagtgtcctcatcaagttgtcctccatgattacaaagctcacagctactatgggggcgggggatgcagtaacaccatgcttagacttatatgtctttgacttaatgggactgtatatccaaagtggtaatagctaacatttattgtagctaacatttcttgagtgcatactgtgtgctggcaccactttgaccactttacacatactatctcatctaatcctcctaaataacactatgaggtaagtattaatagtatccctagtttgcagatgagcaaactgaggcaaggagaggttaagtaactaggccaagatcacacagctagaaaatgatcgttctggccaggcgccgtagctcctgcccgtaatcccagcactttgggagacaaaggcgggcagatcacctgaggtcgggagttggagaccagcctgaccaacatggagaaaccccgtctctactaaaaatacaaaataagcagggtgtgatgatgcatgcctgtaatcccagttactcaggaggctgaggcaggagaattgcttgaacccgggaggcagaggttgcagtgagtggagattacactccagcctgggcaacaagagcaaaactcattctaaaaaaaaaaaagaagaagaagaaagagaaaagaaaatgatggttctaggatcaaaacccaggcagtctgattccagggcccatactcttagccagtgaaggtgtttggctatggagaaaagatggagattcaagttagttttcaaatttttcttattaagtcttcataatcaggtttcactagttgactcagagcaatttgggctcctcaactatcaggcacgctcactttaaaatgaaagtgcaaaaatacaatttaaataaaattactttgaagatatggtattaaattgtccttgccactgaaacccggaaaatgcaagctcagcctgcaaggtgataagttaaaataaatttccttgagtgacgagaccagtgtatatgtaatgattccaagacaattaataccaacacttttaggcaatattaactgttgaaaaatgaatagctttaagatttcaatctctctgttcatccctctggcttctataatagttttttcccttatattggtttttgagctgaactatctgttaatgtagttccgtcaggtctgactattaatctagaaacctgcatttaaggttgattgggagctaaagttgaagaactgactacaaatgatacatgcaaatgttaggttttcatatcctcttcaaacatattgataaatctcactgccatccatgagaattaaaatcggtgcgaagggaaggagataccctagtttctgcatgtatttttctgtttctccgagcctgcaaatagaatgattttaatagcacagtgtgatgtggcacttctcaaactagtcaaaaccagttttagagtcaaagaaccatgggattatagaatatcagactggaaggaacctcagattgttggggctaaccctctcatcttgcaaaggaggagactaacccagagaaaggggctgtaatgatgataatgttgatgatgacaatgcaatgatgtcaatatcaacataaaaacagctaatttttattgactactatgtaccagacattgttcaaaatgttttcaagtattaactcatgtaatcttcatggccaggatctgcatgttgcccagctccaggggtgcaccattcacagtgtattctgtttgaatggtgccactcagagttatgaaacatggccaccgtgattacaaaaagctcaaaagagtagggggacattcattggttttggctgctcagcgtccacactttttctttggaaaattaccctccattagcttcctattgctactctaccaaattaccccaaacatagtggctttaaaactacacgtttattctcttatagttctggagactgtatgtcctaaaatggactagaaggatgggttccttctgggagttctaagaagaattcattttcttgctttttctagcttcaagaggccacctgcatttccttggctcatagccccatcctccatctccaaaatcagcagcagagcaccttcagatctctttctaggtccctctgcttccattatcatgtcaccttctctatctatgaccctccttgctccttcttaaaaggacccttgtgattacattgggcccacccaaataatccaagataacctcctcatctcaagatccttaatcgcatcttcaaagtcccttttgctccataagttaacatagtcacagcttccaggggttcagacatggacatctttcggggaccttaatcagcccaccacatatccttccccactcggctcatgtggtcatgagatgctgataagatggactccgctccctgatgcaggcctcgccaaccaacatattcaacccctgaccagagtggttgctcaggggcgggcaactacatgagtggagtcaatgctgaggcttttccaaaaactaataaagaagaggcacatttttatgggcttgttaattaggttgtatataagcctagtgctgaaaatgaccactgagagagctgcctaagaacgaagataacatggaagggctaacacttccctttccagcagtacagtggattagacaccctaaactcctctcccaatcaaaacaattaaaattctgggaagaacttcttctttagcccatgaaggattaattaacataggaattggccacccaccataaacaactagaaaatttaacaaaatacatcagacaactgcatccggatatggaacaacagaatcataatcccagaagaagaaaaacaaacaagatgagccttaaaattaccctcacttactgccaaaaagcagtttccaagacatggatcaggaagaggaaccaaaacaagcccagtggcccagctgagtggaggatacagatatccaagttcagagaggccacggcacttatcacttgggcaaagtattggagaggaggaaactgcagagggttccagaaagctgcagagatgtctagtactgactgctattttgcacatgcaaagagtgaaactccacataggcaggaaaagagtcatcagtaatcagaaaggattaggctgagcaacttccagagctcatatggagctggaaatagttcacattctcaccagccaaagtagagagatcttgaaatacatggagcattaggtaacatcctcaaaggaatcatgtcacagtaatgatgataaattaacaacagaataaaggtcactctggttttaccctaacaaaactcaaaaggaagcatcaaaaggatcaagctgatttgaaagtaacttaagtgtatgacagaacaaagcccaatactcttcaaagaaatacaactaaatcaaatactcaacaatgtaaaatccacaatgctcatcacccaatcaaaattgctaggcttgcaaacaaaaaaagaaaatatgactcataactaagagaaaaatcagtcaacagaaacagactcaaaaatgaccatcatgaggaaattaacagtaaggatatgaaggcagctcttataaatatggaatagttaaaagacccagaaacatccacccacctgtcccggggtccattctgtttgccagcttagggaagccacagtgtctatggagctgaggtccagctgctccagctcactctcattaagagccagagcaatgcgccccagggagacgatatggtgttctctccagtaagatggcatgtcccaaacctttaggcaaaaaaagaaaatagattagactgaacactgtgatggtatttacaatgatttgaatgtttgtgcccctctaaaatgcatatgttaaaacctaatctccaatgtgatagtattggaaggttgggccttgggagatgattaggtcataagggtggagccctcatgagtgggattagtgcccttgtaaaagagaccccagagagctagctacaagctagtccctttccaccatgtgaggacacagtgagaaagcaccatctatgaaaaacaagtccttaccagatactggatctgccagtgcttcaatttttgatttctcaccccccagaactgtgagaaataaatttctgtttataagttaccagtctatgatattttgttatagcagcctgaatggacaaaggcagtatctaaaatagacataaggaggctaggtgcggtggctcacacttggaatctcagcatttttggaggccaaggcatgcagatcacatgaggccaggagttcaagaccagcctggccaacataacgaaaccctgcctctactaaaaatacaaaaaaaaaaaattagctgtgcatggtggcgcacatctgtaatcccagccacttgggtggctgaggcacaagactcacttgcagaagttgcagttagccaagatggtgccactgtactccagcctgggtgacagagcgagaccctgtctcaaagaaataaaaataaaacagacatagggaaacctattgtgcagcatggtgaccacagttgataataatgtgttgaatggttgaaaattgtgaagagagtagatgttaaatattctcacaacaaaaactgacaacggacaagtatgaaaggtgattgacatgttagcttgctttaaccattccccaatgtatacatacatcaaaacatcatattgtatatatgtatacaccataaatatatataatttgtatttgtcaactatcccttaataaaaaataaataaaaattaaaaagacatagggtaaatcttaatataaagctctcttttaaatcaataataaaaacatgactatatttgttttaaaaaaaagatagacaaaagacatcaacaaggaattcacaaaagaaaaattaaatgtatggggaaaactttattctcagtcataattaaagaaatatacattaaaaacaatcagaccatgttgattcatcacatgtcaagaagtataaagacttatcaccatttacgatactggaaagatacaaggtaagggataccctcatttgttgtagttgagaatataagttggtacatactcttgagagggcaatttggctatctgtatcaaaagcttttaaagtatttatattctttgacccagaaattccacctctgggaatttagcctgagtaaatgagacaagtacccaacagtatatgtataaaggcatacattgaggcatttttttaatgcaacctgaaagtctaacaattagctaaataaataagaactaaccataaataaaatgaagttgcccctgtggatacctccaccaaggattggttccaggacttcttaaagataccaaaatccatggatattcaagtcccttatataaaatagtgtagtatttgcatataatctatgcacatcctcatgtatactttaaatcatctctagattagttataatacctgatgcaatataagtgctatgtaaatatgtacaaaatgttatgtcaaaaatgctactgtatttttatgtgtattgttttttattgttatattgttatttggatcattttttctaaatacattctacctgaggttggttgaatctgcagatgtggaacccactgatatggaaggctaattgtattacaaagctatttaaaatactgatataggctagatgctgtggcttacgcctgtaatcccaacactttgggaggccaggcagacagatcacttgaggtcaggagttcgagaccagcctggccaacattgtgaaaccccatctctactaaaaatacaaaaattagccgggcatggtggcggatgcctgtaatctcagctacttgggaggatgaggcaggagaattgcttgaacctgggaggcagaagttgcagtaagccaagaccacactattgtactccagcctgggcaacaagaacaaaactccatctcaaaaaataaataaataaataaaatactgacatagatgtacattttggatatgaaaaaatatgcagtctgtactgttgggtgtagaaagcaagttattgaatagtaggtaagtataatatcatttttgtaaaacatgagatatatgtatgaaatatataaaataatattttttatatacatagttttggagtctggtaagcttcaagtgaatataccaaaatatcaacagtgcttatctgctgaacagtgcttatcaaaatatcaacagtgagtaaaagattatcactgattttcttctttattattttctgacttttctacaataaacttgaagtactcatataatacataaatacagttatatttataattttaagacattgaattgtttaacccttgagggtaactagatattccacaaccatgtaaagagctaaaacagggctgggtgcagtggctcatgcctgtaatcccagcactgtgggaggccaaggtgagcagatctcttgaggctaggggtttgagacaagcctggccaaacaaaccccgtctctactaaaatacaattattagccaggcatggtggcttgtgcctgtagtcccagctactcaggtggctgagacacaagaatcacttgaacccgggaggcagagtttgcagtgaacaacagatcgcgctgctgccctccagcctgtacgacagagcaagactctgtcttaaaagaaaaagaaaaaaaaaagaaagaaaagctaaaacaggccacaaagggaccttttccttttatttatttatttgagacagagtctcgctctatcaccaggctggagtgtagtgacgcaatctcggctcatggcagcctccgcctcccgggttcaagcaattctcctgcctcagcctcccgagtagctggaactacaggtgcatgccacctgtagagatggggtttcaccatgtgggccaggctggtctcgatctcttgacctcgtgatccgcctcccaaagtgctgggattataggcatgagccactgcacccagcctatttttatttatttttgagacaaggtatcagctctgacgcctaggctagagtgcactggcgcaatcttggcttactgcaacctccacctcccgggttcaagccattctcctgcctcagcctcctgagtagctggaactacaggcacatgacaccacgcctggctaatgtttgcattttgagtagagacagggtttcaccatgttggccagcctggtctcgaactcctgacctcccgtgatccgcccgcctcggcctcccaaagtgttgggattacaggcataagccactgcacccagccaacaaagggacctttttaaagatggaaagctacttccagtcctctttttactcctttctgttatattttcagacaaatttgcaaatgattctgagaaaacctgctgtgagcagcagctggggctctccaggtgaaggaataaagcctaattcctgcaaaccgccttggtcagaggcactgggacatccacagaacttgattcactgagcatctgctagatgccaagacacatctcatcccattctctgccacagccctaagagggaggaactggaaatttcctcctttctcagataaggagatcacaatatcactgagctgatgcagtaaaatttcaagatgatgtatgggaaaactgctcgaggagggttctatgtgcagaaatgctgaactggttttggtgtttttcttttttcctctgtttaatgtttcctccctgaggtgggcttcacctgtattgctttctccttcagggtcatcagctgaggccggctgaaaccctggacagctcccagcagttccacggtcctgatgaatgtgtcttcctccatgcaccgcaggtcctccagggcccagcaggcgttggcttcggccaacttgaagatgtcatcagaagagggggccacgactccatggcaacctgaagaaaggagagatgcagggaaggagaagaggaaagagaatttcaggaaatgttagtgtattgaaatgagtaacattctttgccagtcagatttatgcatggaagggactacagagtaaaagcagagagcaggaggcagggaccagtttgaatcccacttctgccatttcttgctaattactgggtaacaaagtcatggaaatgccagctttttgcacatccacatgcacaaactaggagcggtgcaacattacaattaaactacaaattccttgagggcagtaagagctggtggtgaacagtcctgactttcgattcaaatccaaggctatttaacctctctgtatttcagttttcttgtctataaaatggaaataaaatcgcctcataggatggttgtgaaaactaaatgtgttatatgtaaagcacttagaacagtgccacgcatacagtaagcactcgatacacaatttctgttgcctatcttaccccctatgcctttgagtttgcagcccagcataaagattccaaaattatgcagcagccttcctataaaaatgggaagatgggctgtgcggtggcgcatgtctttaatcccagcactttgggaggccaaggcagaaggatcacttgagcccaggaattcaagaccagcctgggcagcatggtaagacctcacctctaaaaaaaaaaaaactacaaaatattagctaggcatggtggcacatgcctgtagtcccagctacccagcaggctgaggtgggaggatcacctgagcctgggaggtcaagattgcagtgagccgtgatcacacctattctccagcctgggtaacggtgagaccctgtgtcaaaataaaataaaaaataaaaaccaggaagatgagttgctgtccatgaaaatcatagtgggggttgtggctttcccatcccaagagaaaagagaaatgagcctattgcatttctcttggcaacaggaaaaacatccatttcggtctttgaataatgtgaaccttacctactcaaaccagctaccaaccaacatgcaagtgagatattgtctttgctggatctgatgtgcccaacctgggagaaaactctaggatccttaagagcaaccctggatttcttatcttagccgcagaccaccactgatgctgacagatgcaccaaccccacccaaggccagggtatttcccgagccccatggcctctctcttctcattgcaccttcaatggaaattcactgcattccaatcacgaggcaaaagtagaccagatcaaagatgccagttgtggtcctcaaacatctttatcataagccacttggagaggactaaagacccatccctccctaggccaacccccagcccaccctctagtgaaaacaacatcagtgatagcacagaactagagagggcagaatggttgactagtatatcaggaacttggtcttatcactgtgtctgtccagggcttagaatagagcctggtacatcgtaggtgttcagcaaatatctgtggagtgagtgaacacacacacacaaattaatataaaaccaagcggtaattctgctaatccatcaatcactaaagcacagcagcaattaatacccagaaccaactaaagaacactcaaactatgcactgataccagagcttccttcccctgagcatggaaagccttattttgtgtaccacatgcacacagtaagagctctgcaatatgatgacatggactgctagaccttgagggcagtgggagccagtggtggtcaccaccaactttgggtacaaatccaagaactgccatttactaactctgtgactttagacaagtcccttagtctcctaagccccagtttccttcatttaaaaaacaagagaacacccaagcctggaaatctgcagccctaaatgggaataggcattcctgttttcacgcccaaatgttaggttttggcctgccacatcccactatcctgtacccatataaaccccaaaccccaggctccatgagcatacaagcagatgagcagatgaacagaagagaagaggagcagaagagcagcatggcagagaaaggagcatctgaaggccaagaagagtttggctggggacagttggagaggagattggtcacaggacagccaaactccaggggaagatcatcttcccactccatcccctttctagctccccatccatcccaccgagagccacctccattacccaataaaaccccacattcaccaagaaaaaaaaaaaacgggagaacaagataatgcatggagggataatcacccaaggtagacacaaatccaattgtgatacttctttgctcgatgtcacacgatgcctccacccagagtaaaagccaaagtcattagggtttcctttaacagtcactacatggctggccttgtctctcactcccctccaaacacactggcccttacctcccactcatggaagtggtcctgttgcactctctgcctggaagactctaattgaaaatatccacatggcccactctcccttgggtcttcattcaaatgtcaccttctcaataagatgttccttcatgattctcttttcacatgacagtcccctctcaacactcgtggtgcattcccttgctttattttccttcttggcacttttcatacaatataccatatattttacttatgtatggaaatttattgtcttgctaccctccatttgaaagtaagctctttatttacaaaattggtgcttaacgaatatttgttgggtggatgaaagcaagcactgactgtcaactactatcactgggggtgattaactttgtctcctcatgcctggccccagtctgcacttagtaggtgcatggtaataataataaaatatctaacacttggacaggcatggtagctcacatctataatcccagcactatgggagaccaaggcaggaggatcacttgaggctcagagttcaagatcagcctgggcaacacagtaagaccctatctctacaaaaaaataaaaaattatccagatgtggtggttcatgcctgtagtcccaactacttgtgaagctgaggtgggaggatcccttgagtccaggaggtcgaggctgtagtgaaccatgattgctgcactccagcctgggtggcagagcgaggccctgcctctataaaatcaaattttaggccgggggcagtggctcacgcctgtaatcccagtatttcgggaggccaaggcaggtggatcacctgaggccagcgttcaagaccagcctggccaacattgtgaaaccccgtctttactaataatacaaaacttagccaggcgtggtggcacatgcctataatcccagctagtcaggaggctgaggcaggagagttgctgtaatctgggaggtggaggttgcagtgggccgagatcatgccactatactccagcctgggtgacactccagcaagactccatctcaaaaaataaaaaaaatcaaattttaaaaatatataatacttattaaagatctgctacatgccaggcattccggtaaacatgtttctgggtttaaacccattaattctcacaataacccagtgaggtagagactttcattatccccatttgataaaggatgaaaactgaggcacacagaggttaaagagcttacccaaagccacacagccagtaagtggcagactcaggagtgaaatgtagccagcccggccctgtcactgctatgttaaaccactaatccatgttggtcctctaagtcaatcctactgaaatgtttgttacacatattcacgcattaaacctactagcctgggtatggagtatgggacatgattccaggtcactttacaaaagtgtaactcttttttttttgagacagagtctcgctgtcacccaggctggagtgcagtggtgccatctcagctcactgcaaccttcacctcctgggttcaagcaatcctcgtgtctcagcctcctgagtagctgagactacaggtatgcaccaccacacccggctaatttttgtgtttctagtagagacagggtttcgccatgttggccaggctggtctcgaactcctgacctcaagtgatctgcctgcctcaacctcacaaagtgctaggattacaggcttgagcaaccgcacctgaaccaaaagtgtaattcttttgcttatagattttgtcattctattgctttgcagacatttcatccagttccctgcataaggaggcctcttgatgtcagggaccctgcccaaaacattaattactatgtcagcaatggctcagataccctgaaaacactcaccaggcatagggtcatagctggggatcttatcactgctgttccgaacagactgaaagacagcccagaggaattctttagtgggcagggtcctggccatcttggaagctgcttgcagaaggatctcaggaaactgtgtgaaagaagatgaaagaagaggaataataattaaaaccccttaaatacagattgaaattagagttgaaactgtcacactacttactgccttcattctttgttatagcaacttctcatataaatctattccctagtcccactaatgtggtctctataaagaatcctataaaatgatactcaacttcaataaaaatccaataaagtctaaaaaacataagtaaatcacttttcacccatcagattgtcaaaaataaaatgaagtgctaatacttaatgctgggcacattcatttttccgtgggactgtcaaactgtgcactattagcagagcaatctggtaatatcgacaaaaaatgtaggttaggcgaggtgtggtggctcatacctgtaatcccagcattttgggaggtcgaggcaggcaaatcacttgaggtcaggagctcaagactggcctggccaacatggtgaaaccccatctctactaaaaatacaaaaattagtcagtcgtggtggcatgagcctgtcatcccagctacttaggaggctgagacagaaggatcaccagagcccaggaggctgaggttgtagtgagtcgagagcatgccactgcactccagcctgggtgatgggagtacaaccctgtctcagaaaaaaacaaaaaaaatgtatgtgtacctaccccttttttggtttggtgctatttctaagtttttactaaactttatatttgacatagtttggatgtgtaccccacccaaatcttattgaaatgtaatccccagtgttggaggtggggcccagtgagaggtgattggatcatgggggcagatttctcatgaatggttaaatacaatccccttggtactgtcctcacaatagtgcgtgcgttctctcgagatcttgttgtttaaatgcatgtagcacctcccccatcacgctcttgctcctgtgtcggccaagtaagatgtgtctgctcccccttcgccttccgccatgattgtaagtttcctgaggccttcccagaagctgggcagatgccagcatcatgcttcctgtacagtcggcagagccatgagccaatcaatcctcttttcttgtctctttttttttttttttttttcagagtcttgttctgttgctcaagctggaatacagtggtgtgatctccactcactgcaacctccacctcccaggctcaagtaattctcgtgcctgagcctcctgagtagctgggattacatgcatgcagcaccaagcaggctaatttttttttatttttattgtagacaaggtttcactatcttggcctggctggtctcaaactcctggcctcaagtgattcgcccacctcggcctcccaaagtgctgggattacagatgtgagccactgtgcctggcagtgtttgtttgtttgtttgtttagacggagtctcgctctatcacccaggctggagtgcagggcacgatctcggctcactgcaagctctgccccctgggttcacgccgttctcctacctcagcctcccgagtagctgggactacatgtgcccaccaccacgcccggctaattttttgtattttttagtagagacggggtttcaccctcttagccaggacggtctcaatctcctgacctcgtgatctgcccgcctcggcctcccaaactgctgggattgcaggcatgagccactgcacctggccctttttattttattttttttaatttaacttttattttaagttcaggggtacatggcaggtttgttatataggtaagcttgtgtcatggaggtttgttgtacaaattatttaatcacccaggtattaagcctagtacccattagttatttttgctgatcttctccctcctcccacctttcactctccaataggccccagtatctgctgttccattctatgtgacaacgtgttctcatcatttagctcccacttataagtaagaacatgcggtatttggttttctgtttctgcattagtttgctaaggatgatggcctccagctccatccatgtccctgcaaagaacacgatctcattcttttttatggccacatagtattccatgtaaacctcctttctttataaattacccagtctcaggtatttctttatagcaatgcaagaattgcctaacacaggtcaggtgcggtggctcacacctgtaatcctagcacttgggaggcccaagcaggcagatcacctgaggtcaagggttcaagaccagcctggccaacacggtgaaaccccgtttctacaaaaaatacaaaaattcactcggcatggtggtgtatgcctataatccctgctactcaggaggctgaggcaggagaatcacttgaacccaggaggtggaggttgcagtgagccgaaatcgtgccactgcattccggcctgggcaacacagctagactccatctcaaaaaagagaaagaaaaaaagaattgcctaacacaacatttgtcatgaaaaggaggtgaagaagggttgtctcaacatcctgggtggagactagcaatgaggggacttaggggactttgggttgccttggagaaagtgccatttctcatctagaacgaatacactttgtcaagacttgggattttattagaaggcctgcccatgggcccagataatccatcaggctctacaaacagctatgcctcactgggtcccggctcacccagagagcaagcctctcagcctatgtagctcccctttctagtctcatcttcagaattagagtcacagtctaagccagcagttcttcaaccctggctgtacctaagagtcacctgggacacccagagccagcccctaaagattctgactcagtcgggctgggctggataccatggattggtccctcttggaatctccccaggtgattctaatgtgcagctgaggctgaaggcaaccactctaagacagttaacttttagaaagcaatatgcatagcggagtgaatggcattttccattttgtattttctaaagaagagtgtgtatatgctcttgtgtttttagtagagacagggtttcgccatgttggcgaggcttgttatataggtatttttatacctatataaaacttgttatatagatattcaggatatttctgaaaggatgcagaagagattggggacagcaattgcctctgaagagggaggctagggaactagaagtctggggtgggagggagacttgcttctcatcctattacctttggtgcgattgggatttgttaaccaggagcatgtattacttgctttattaaacatttccagtatttaaaaaaagagtatacagaataatacaacaaaacacccatgtcctcacaacccaacttaagaaataaaacatcacaatataaataataagtccctccttcactctttgccttcctccttccccagaagtaactgtcactctgaatttggcattcacttttacacttctcttacatataaacttggcttacatttgctttaaattaattcagctactatttatttatttactttgtatcctactatagatattcttttgcaatctgggtttttttttaactctacactgtgtttttgagatttcacagtgttgatgcaagactttttcaatttcagaagttgatttttttaagattagatagatatatggatgttctcactgatatgtgggagctaaactatgaggacccaaaggcataagaatgatacaatgggctttggggacttggatggaagagtgggaggggccaagggataaaagactacaaatatgttgcagtgtatactgttcaggtgatgggtgcaccaaaatctcacaaatcaccactaaagaacttactcatgtaaccaaacaccacctgtaccccaataccttatggaaaaataaaaataataataaacatctaaacataagaaaaacaaggaaggaaaaaaaatagatggatatataacatttgtgcatcagggccgggcatggtggctcacgcctgtaatcccagcacttgggaggccgaggcgggcagatcacttgaggtcaggagttcaagaccaggctggccaacatggtgaagccccatatctactaaaaatataaaaattagctgggcatagtggcaggggcctgtaatcccagctactcgggaggctgaggcaggagaatcacttgaacccaggaagcagaggttgcagtgagccgagattgcatcactacactccagcctgggcaacagagggagactccatcgcaaaataaaataaaataataaaataaaaataaacatgtgtgcatcaactgcttataactatatattcagacatccagaatatgattttactgtgactggacttcagaatgtgctgcgtgtgatcctaggtgaagttgtgtgtgttcaggccctgctgagcatgtgtgaccatgtgcaccttgtgcctgcaagtgcaggtatgagagtgtgtggatgtgctttgtgggggatctgattgtcattcagcaaacattcactcctttcctgccctccacctccatggaaggagactccttcctgccccattaaagttggtcttggtcatgtaacttactttggccattggagtgtggcagaagtgacagcgtgccaacttccaacctaggacttaaggagaattgtacttatcccttcccttttttggtagtttcataccttcatggtaagaaaaacaagttctagagcagggctgccccagcgacccacaaatcaggcagcaaggaacatatgcgaattgttctatgcccttgagattgtgtggctttgttatgcagcacaaatgactaattcatgcttattttgcatgccccttggtctagactgtctaacttctggagccttactcctagaaaagcgtcatgcccaaatgtaatgatcaataaagacttgttattggattaaatgtgcttgcacatgtgattgcatacactggacatacatgtgcatgtgcatagggcaccagccagtgtgagagccagaacagacgtgcgtgtgagatgcacactaatagcagagtggtagctaagtaatatctgtctgcacacatctgcctggggggccacacaaaagggcctgagttcatttagctgtggactcactcccttttccagaaccttgcacatcctggaatggagctggaaacatcttagcccttggaggcagggaggaagcttccagaaccatagacagcagtaaacccaatgctgtataactgaccacactttctctccccttcaaactccttcagccttcttaagatggagcacaacattacctttgtggctatagagcttaattcatctcctgagaaaagtactagaaagggtcccaagtccttcgtggtctcggctgtccagtgctgagggagtctaaaaagagataataaccagtaaagtgaaaaaacatgctgtggtggacatctgttgccttttcccccagcacccttttctttcaggaatagattgtcttatactcatgtcaatcacatggtcccacttccttgaccaagaaaattggcatgtgatgcaggctgaccaatcagagtcatccctgggagttttgatggaactatcagagaagctctcctttctctggtatctctggcagtaggggaggatattggaggacattcatattaccaagtggaaaaagtaaagaccacaccaaggaacacagagctgagggatgggaggaacatattcctgaagatatcatttgagacacgggattcagccatgcctgaagaccaccagtggagtttcccgttacattccattcctgaattcaatacattcccgttctctttagtttgaattaaattattgaatttctgccatttacatcacagtgtgtccttcttctccctcctcaatagaagagtaattatatatttcttccttttactttaccataacagtcttctcttagaataagaaaaaacctttctcttgaacttggcaggataaaataaaggcactgacccagaatccactgttattcttgtatagatcataaatgcctacagtgaagagcattacactatctttggcgacatctctaaaggaggtctgcccaattagcagtgacagctggtgggaatgcaaaatcatacagccactttggaagacattttgttggtttcttacaaaagcaaacatgtttttgccatataacccagcaaacacactctttggtatttacacaaaggagttgaaaacttacgtctacatgaaaacctgtatatggatgttgatagcagctttatccataattgccaaaacttggaagcaaccaaatgtccttctgtaggtgaatggctaaataaactgtggttcattaagacaatgaaatatgattcagcactaaaaagaaatgagctatcaagccaaaaaaagacctggagaaaacttaagtgcatattactaagtgaaagaagtctatctgaaaaggctatctactgtatgattccaaatatatgatattctagaaaaggcaaaagtatcagtggttgccaggaattaggagtgagagaggaatgaacaggcaaagcccggaaggatttttagggcagtgaaaatactccgtatgatactataatggtgaatacatgttattatatacttgtctgaacccatagaatgtaaagcaccaagagtgaatcctaatgtaaaatatggactatggatgataatgagaatccaatgacgataatgtcaacataggttcatcagttctaacaaatgtacaactttggtgggggatattgatcatggggagcttatgcgtgtacggggtcagagagatatgggaaatctctatcttctccatttttctgagaacctaaaactagtattaaaaatagtctctagggtcaggcatggtggcccatacctataatcccaacactgtgggaggcttaggtgggtgaatcccttgagcccaggagttcaagacccacctaggcaacatggtgaaattccatcccttaaaaaaaaatacaaaaattagctgggtacagtgatgtgcacctgtggtcccagctacttgggaggctcaggtgggaggatcacctgagcccagggaggttgaggctgcagtgagccattactgtgccacagcactccagcctgggtgacagagcgagaccccatttaaaaaaaaaatagtctttaaactaataataataccactaccttgcatctgtaaagggccaccttttccaaatttccccttcatatgccaagctgtgtaagaaacaactctttgagatttttagggcagctactattgattccactttacagcaaatctgaagccaaggccaggcgcggtgactcacgcctgtaatcccagaactttgggaggccgaggtgggtggattacgaggtcaggagatcaagaccatcctggccaacatggtgaaacccagtctctactaaaaatgcaaaaaatagctgggcgtggtggcacatgcctgtaatcccagctactcgggaggctgaggcaggagaatcgcttgaaccagggagtcagaagttgcagtgagccaaggtcgtgccactgtactccagcctggccacagagcgagactccgtctaagaaaaaaaaaaaaaatctgaagccaaaagaagaaaggtcacatttccaaaataagcataagaattttatctcatcctaagccagagactctgtttgcagggcaggagagccaaggttgagtgtccctccacagagcataccacaccaccaaaagccaaacccagccgctcctcacccatactgtcccaggagcttgagcctcactgcagccttttgctcagggttgaggtctgggcagtctctgaggccgtgtagagcagtcgcccaagccctgggggagatccccctgtcgatgatggctgccggcaagtgacacagcaggttccccatgatgtccacagtgtactcatcagcaatggagtcgtcctgaacccaaaaagtggagccaatgggcagttccaacagagcataagatcgtgagccattagaaacacatcctgtggggtgggcactgtggcttatgcctataatcccagcactctgggaggccgaggcagacagatcatttgaggccaggagttcgaaatcagcctggccaacatggtgaaaccccatctatactaaaaatacaaaaattagccaggcattgtggcacatgcctgtagtcccagctactcgagaggctgaggcacaagaattgcttgaacccgggaggcagaggtcgcagtgagcctagatgatcatgccattgcactccagcctgggtgacagaggaaaactctgtctcaaaaaaaaaaaaaaaaaagttccgatcccaaacttcttaaagattccaggatcttaactgcctaccctgccatggattcctagagatggaacaggacctgatcttccccagggatgcaggcctcagaaatctggaaaaccctggcttggcacaccaggagcactcagtaattgagcgctgctgtcactgttattgctctgagaatattccagacttcaaccaccattatactattggcaccacaacaatgaaaacagcacttcaaagtttgtatgccacttgaaagccttcaaagctcttttgcactttcacaaaatgacaaaaatagttcacatttattgtgtgtttcctatgtgcgggcaccgtcctgagtatctgtgggtctcaatctagtcatcttcaaagtaactgtaagaagtaagtactactattatccattttttaaagaaaaagaaactgccagctagtggcaaggctaggattcacacccagacaatctggcctttgagcctttacattaaataatacattgcccatgtcatgttttcaatactctatgaggagactaggtatggtggctcatgtctgtaatcccaacactttgggaggccgaggtggatggatcacctgatgtcaggagtttgagaccatcctggccaacatggtgaaaccctgtctctactaaaaatacaaaaaataaccgggtgtagtggtacacacctgtagtcccagctacttgggaggctgaggcaggagaatcagttgaacctgggaggcagaggttgcagtgagctgagatcgtgctactgcactccagcctgggtgacagagtgagactctgtcccaaaaaaaaaaaaaaaaaaaaaactctaagggggatgtgctactccccccaccttacagatgagaagactgaggctcagggaggaaaggtgattcacccaaagccacataaccaatcactggcacccagtctctgggtactgtgctctttccattcctccagagtagcctcccctcctttgggccgtggggcagaagtctccagaaccaatggaaaagattgttccaaccagcaactttagagtaagcttcaagacccaccagtcagacttctggccatcacagcaggctcaagatcctagccagatccctcacagggctccccaagatggccacagatacccagagggaggggacacccaggaagagttttcttaccaggcactgctgcactttcctgaggactgaagtctttttgtgggaatctaaaaccaaggagtccaaccagctcttccccaggctgatcagaaagggcacacactgggaggctgggacagaagccaggtagcgggccctggagagagatggggagaacaagaggaggaacacatggctgctcctgttggcccctaaaatcagggttcgcctgcccaagagctcatcccaaagacattctttaaatgtttgttcttcccagtgatgctttggctccctgcagcaggtagcaagcttcccacccatcatgctcctcttctatgggtgggaacaaacttcccatcatgctcctcttccatgaatgggcaacaaacttcccatcatgctctcttctatgggtgggaacaaacttcccatcatgaccctcttctgtgggtgggaacaaacttcccatcatgctcctcttctatgccccagagcattgatcagagaatgggttctcgtaaatagacatgttgattgatggactggttgaggggagatgaaaaagaaaggaaaaagtagatgaaaaaagagacaacgaggagagagaataactagaaagtgagaaagaaagataagaaaaagagtggaaagagaaattctgtcatctccagtccagaactctgccttccactcttgatccttcagctcttgacaatgtattctcaacagggtcaaagtcaccctcaagaaggagaaactggtttggatggagataaaaaagactgttatgacaacgatctgtaacccactgaagctcattcctactcaaaatatttttcctcagtgtataatttctttcattcaggagaaattaaaattttctcctttggaaggcattaacaaaagttgagaaagtctgcatgaaacccatccggcctactcaaccccaccacttcactgttccaaaaccagatacaacgtcttcccccaaacatgttcttccgcctctatgctatcccacactcctttttttctttatcccaagcctgtcattgctatctccttagcattatcccaatctgttcttacttctggccaggtgtggtggctcacagctataatcccagcactttgggaggccaaggtgggtcacctgagatcaggagtttgagaccagcctgagcgacatggtgaaatcccatctctaccaaaaattcaaaaaattagctgggcatggtggcatgcacacctggggtttcaactactctagaggctgaagtggaagaatcacttgaacctgggagacagaggttgcagtgagctgagatcgcaccactgcactccaacctgggtgacagaatgggaccccgtctcaaaacaacaacaacaaaaaaatctattctaacttctccattcccagtaccactgtcttatttatttcttcattcatccagcaaatatctacaaagcaactacagtaagccaggcactgttctaggcaccaaatataacaatgaacaagacacaagtggtccttaattctagcagagagaagaaacacagaaaccagtgaacaaaacaagacatttgagctattaatagctggcatggtggctcacgcctgtaatcccagcactttgggaggccgaggcaagcagatcatctgaggtcaggagtttgagaccagcctggccatcacggtgaaaccctgtctctaccaaaaaatacaaaaattagccaggcgtggtggcgcacacctgtaatcccagctactggggaggctgaggtaggagaatctcttgaacccaggtggcggaggttgcaatgagccaagattacaccactgcactccagcctgggtgacagagggagactctgtctcaaaaataaataaattaattaattaattaattaatgtaaggaagaaaataaaatggctctgtaaaagagaatgacaatggggataatcaaacgagccccttctaaggcagttccatttgagctgagacatgaatgagtggtagaagtgccatgccaagatctgggttactgaaataatcttcagctgtctcccttctttccattcagcctccctgcattctatcctctatgtgggtagtggctatgatctttctgaaatataaatctgatggctgcacacagaatatgtgtgaaacacctcactttacaaagcccccatgatctgatgtcccttaactctctggccttctctcccctatctactctgcagatatacccccatgtgttcccagagtgattggcttttcttacccactgctgaaccggacatccccattccactgcctggaatgtccatcttaaactctctatccagcattagttcggtctcccctgtctctccagtctatgggtgatattccctcctctatgtccagtcctcattatccctcccctttgcctctcctttggaaggcaataaaaaagttgagaaaggctgcatgaaacccatctggcctagtcaaacccaccacttgactgttcaagaaccagattcaacatcttcccccaaacatgttcttccacctctgtcctaacagaggtgtgtaacagcacctggctttcttggaaagcacctagtttttcttggagaaccatctccctcactctaagtccttgtggtttctctccagctccaggggtgcaatacagattgaagtcagtcaaagttacccatcctcccaacctcactgattggttcaaggaaaacaaattcgcccaattaaggtcaatgagagtcaaacccaagatgtgtattgagaatgatgggaagagaacatttttctattttccctgaatatgaaactgggaaaatttaaccttagatcttccagggttcccacagaggaacaacttgcctgatagtgaagccaacagagaaaagctgggacaagagacaaatgacatcatttgcacccctagatcgagccatgcctgaagtccctctctgaactttccagttacctgaacaaaaaattcccttttattgcataagccagtttcagtttcagttctgttgctttcaaccaaatatcaacctgatataattggcttcatgtttgtctattccctctcccaccatgagattataaggtcttataaattaataggaatttctaaatcttcagatagaaaatttagctatctgagaactagcacacagcaagtactcaatgaacttttttttttttttgaatgaacgaagacaataagagcaaaaaaaggtagagggaaataaagaaggagagaaggagagaaacaatgtccagatcatgtttgaaaagcagggccaccctgcaggcccaaaagctcacacatgccaggagaaacgcctactgctcccctcaactctgattcccctggagcctggcacagccgcaaagccaggccagatgggacctgcctcactgacactcattcaggcttgggttgctttggcttggtttttagataacaggaaaagcaagaaggtctgtctcaaatgtctgtgtgatactcagaattgaaatcctggatctcaagggcttaactctctaaggcatcctccactctgcctctggttcctgaagaaaacccagtggggagagaatcattttgacttcagtgattcccaccgatctcactgatgagccagaaggtgggggctgatgttcacttacgggagtgcagccaagaggaaaggtggcatagacaatctggaaacttcccagtatttccacgccaaacaattaacctgaaagattaagcagttctggggatttaatgcagtaagaagaagaacaaacacagtgctttccatgtgccaggtactattctaagtgcttcatacgtgttcatttatgcaatagagcaccctatgatgtgagtaccactactgtgcccagtttatggatgagaacgctgaggtaataacaaacatgaacacggacatttaagtgtgagaatgctcatcgcaattttgcttatatctgcaagaaagggagatataattttaatgttcctcagcaggggattggttaagtaaattatggtatatacatacaatggaatagtgcacctactttgttttaataaggtagatttatatatatattaacactaaatgatgtctgtgctattttatgcatgtgcatatatatagttatattatatataatgtaaaaaccacaaatgggctcatattgtacacacaattctgttaaactatatatatagcttaactatacatatagttatatatagcttaactatacatatagttatatatagcttaactatatatatagttttatacatatatatatcttagctatatatataaacagaacagcatgtatagtatgagctcacttgtgttttttttttttgttttttttttgagacagtctcactctgtcacctaggctgtagtacagtggtgtaatctcagctcactgcaacctccgccttccaggttcaagcagttctcctgcgtcagcctcccgagtagctaggattacaggcaccccccaccatgcacggctaatttttttttttttttgtatttttagtgggtttttttggggttttttttttgtattttttaaaaatttttttaggttggccaggctggtttcgaactcctaacctcaagtaatccacccatctcggcctcctaaagtgctaagattactggcgtgagcactgtgcccggcccacttgtggtttttatattacatatagatacttttttaaaatttggtttagagatagagtctcactctgtcacccaggctgaaatgcagtgactccatcataactcactgccaccttgaactcccaggttcaagtgatcctcctgcctcagtttcccaagtagctaggactacaggcatgtgccaccatatttggctaatttttgtatttttttgtagagttagagtcttgctgtatgtttcccaggttggtttcaaagtcctatcctcaaatgaacctcccacttcagcctcccaaagtgctagaattacaggcatgagtcattgtgaccggcctatattttatatataaaagaaaactctcaaaagtaatagcaaactgttctttatagttacctctgaaacacagttgctcacctcagtattattgacattttcgaccaggtacctctgtgtagtggtgctgtcctacgcattgtaggatgttgagctccacccctggcctctacccactagaggccagtagctctgctccggttgtgacaaccaaaaatgtttgcagacatggccaaaagtcccctaagagggcaaaacagtactctgttgagaacaactgctctggggaaaatttggggaaattttactttctctgtattggttgtttgtgtgtgtgtgtgtgtgtgtgtgtgtgtgtgtgtgtgtgtgtgtaataattatgtgttttcagaatgggcgtggtggctcatgcctgtaatcccagcactttaggaggctgaggctggtggatcactggaggtcaggagttcaagaccagcctggccaacatgatgaaaccccgtccctactaaaaatacaaaaattagccaggtgtggtggtgcgcacctagaatcccagttagacaggagactgaggcaggagaatcacttgaacccaggggcggaggttgcagtgagattgaaccactgcattccagcctgggcaacagagcaaggtcctgtctcaataataataataatgataataataataataataataataatgtgttttagtaaaaatataaacgagaaaggcaaattttctaattaactggtatttgaaggctctgagagctggaagcctaggaaagcaccttcactggggcaactcttcctgctcgaacatgtaggtcttcctcaaagcaggtctagcttccatccatttgctcagttattggcttgcccacctgggcaggtcttttaatatagttcagtggtttgtaccagcaaactgattagaaatgcaaagtattaggcctcaccccttacctactatatgtaaaactctgggagtggggcccccaatttgtgtttttacagccttccacacaatgctgatgcaagctcaactttgagaatcactaacagaattaacagtccaagggaatgagagagcttcattaaaactttgcatattcctgtaatgatcttgaaggattatacaccaagcactctatgcttcctggttttctgggagataatttactctttggaaattcttcattctggtctgaaacacaaggccagagttgagaaggtgctttttaatatccattacaggagtctgtaagccagcggttcacaccaaaagttcaaatgctgtaaggcctgtgtttactagcttagacactgaaaaatcagtcactggctgggtgaagtggctcatgcctgtcatcccagcactttgagaggctgaggcaggaggatcacttgagcccaggaatttgagaccagcctgggcaacatatcaagaccctatctctgcaaaaaataaataaattagccaggcatggtggtgtgtgcctttagttccagctactcaagaagttgagacggaaggatctcttgagcccaggaggttgaggctgcaatgaaccatgattatgccactgtactccagcctgggtgacagggcaagactgtgtctcaaaaaaaaaaaaaaaagaaatcagttactgcttctagtctccccaaaggttaaatagcctccataaccttttagaaaatgaagttttaagtgagaaagaaaatgttctcagagtactgtttgcattcacagctactcctggaaagtgttggaatattagctgaaggagtaccttccatcccacgggaacataattatgaacacacaaaatactgtcccttatgaatatattttaaggcttaaatttgagtatggaataaccaatctgttgattctttggctgtagtgatgtgggtatttggagctgtttaaaaagaaactggaaaaaacctggctcaatctttggccctaagtcatcacttgcgtctgaatgattctggcataaagatctttagatgccacagccaatccaggcccagtgactggggtagggagagagaattagaagctggaaaatgctttaacggtacctgatagggtgaaagcagggcgaagttgttctgaaaatcctggaaatgggccagaaagaagtcagtgctcatggcatcaatgtgtgagcaggtcacgcctttgaccagctgcccagcactagaaaacaaaacaaggcactcgggagaggaaggaagtgaggaggagaggaaagaaagagcgagagaaggcagatatgatcagatacaagctacagatgtgactgcctaactctcccacctggaaaagtaggctgctctggcagaaggctctgaaaggcctgttcagcacccaggccgagttacattttcctacctcaaaagctcctcaggccttctggtggtctttaacagaagctcatacaggaacagagcctgcaagaagagaatgatcgttagcactgatggcacactcagcgtgtgcccaacactgtgaggccctatcaggaaggcattccacaatcccattttacagatggggaaatggaggcttaacaggctatgtgagttacctaggactagaccattgctaagtggcagtgcctggatttgaaccagtgtcaaggtaattccagagccccactctcacactccagatgattctctacaccccatgaggcagatgagaggcaaagacattggtggcagggctggagttttacttcctgtgctttaggaagctgctgaccagttgagaactccctgtgtctcctattcacatgtgcacctgccaggttctgaacaccaggcatcccagaataaaccaggatgggctagaaagcaccagcaataaagtacctgcagctagcagcatgcactgtcttcaaaccaccccccaatgagcactctagaacaatgcctagtagacaggggagtcatttgttttaaggaacataattttacagaatccctaacttgcagacgcaatcaagtactacatttgtctattttatagactctgaaactttgagtatcattccccagacagaataaattatgagctagcattagacatggtagctgagagccaaaaagcagcacaaaagcccaggcaaaaggaatggacgatggaggaaagttctggacactgtttgtggccccagagattttcctgggctcagggtcaaattctgggaccctcccatggtcttccccatctcaggaaacagcaatcccatcagctcaatggccgagacaaaagtatcttgaagtcttcggtggcagaatgtattttccaaaataaaactattggctgggtgccctggttcacgcctgtaatcccaggactttgggaggccaaggcgggcagatcacttgaggtcaagagttcgacaccagcctggccaacatggtgaaaccctgtctctataaaaaatacaaaaattagccgggcatgatggtgtgtgcctgtaatcccagctacttcaggaggtggagccatgaggattgcttgaactcaggaggaggaggttacagtgagccaagattgtgccactgcaccccagcctgggtgaccgagagagactctgtctcaaaaaataaaacagaataaaataaaacggttgccactgtcactaaatttagaggtggtttgtgacacagcaatagatcagcaggacatcatccagcctcatgagagaccctgagcaagagcgcctggaacagacagggatttgtgtcgtttcattcacttttgcacactcagcactgtgagcagtgcctggcgcactgttgggctgtgcttgataaacatttgctgggtgcatgtaatgaagactgactgaatacaaaggtagtcaacgatggtactaaggcagagcatccacttcaacagcaccatccccccaagcggcctcaatgctcacagcatttaataatacacataatagccgcgaatacttacagtacacagcccaggtggcatgtatcagtgaccctcattttattatcaaaattatccccatttcgcacatgagaaaactgaggccatataaggaacttctccaaagctaataaataagtgggagccagaattcatgctcaggtcttgtctaactttttttttaagagacagggtctcgctctgtcgcccagactggagtggagtagcatgaccataactcactgcattgcggaactcccatgctcatgtgatcctcctgtctcagcctcctgagtagctgggaccacagacatgcatcaccatgcctggctaattttttaactttttgtagagacaggatcttgcttgctatgttgcccaggctggtctcgaactcctggcgtcaagcgatcctcctgcctcagcctgtccaaattcttaacactatactattctgcctcctatactaatcccacagaaataaatttcttttatcaaattaaccttaaaacagaccattcattctcacaagacagatagtcagaaatacaggatcgatctgtgtttcatggtaatacctggctccttccaagttccttatccttcaggactgtagagttgaatccaggttgcctccttaaatcaaagagagacacttccttaaagaaagccccttgtatctccacgatgcctggggcagtgtcttccgcttggaccatctgccagaagcgagaagcaacaaaacaacattgtaaaaaatgcattgagctttgaggaagggccaggcactacatcacaggcaataaaatccatcagaaccgctcagcaaccctaggaagtggagagtagcatcatccccatttcacaggtgaggaaacagagacttaaagtgtgatgagttgaaagtcagtaagtgacattcaagcccaagtctgtctgattccaaaacccgtgctccttatttctttattttaactgtatgggctacttgctatctgcaaggtattggtgttttaggccaaaccccttaggttttagggtttttttctttttttgagatgggaatctccctctgtcgccaggctggaattcagtggcatgatattggctcgctgcagtctccgcctcctgggttcaagcaatttccctgcctcagcctcccgagtagctgggactacagaagtgcactaccacacccggctaatttttcgtatttttagtagagacggggtttcaccatgttggccaggctggtctcaatctcctaacctcatgatccgcccaccttggcctaccaaagtgctgggattacaggcgtgagccacctcacctggccaagttttggtttcttaacagattttgccattggacagaacggacctgatagagcaagatgtcaaaagactccctgacaagtaaaaaaggggccaggcatggtggctcacacctgtaatcccagcactgtaggaggccggggcaggtagatcacttgagcccaggagtttgagaccagcctgggcaacatggcaagaccccatctctagaaaaacaaaaattagtgagcagcacaggcctgtagtcccagctacttgggaggctgaggtgggaggatcccttgagccccagaggtggaggctgcagtgaaccaagatcacgccactgcatgctggctggggtaatagagcaagaccctatctaaacaaacaaacaaaaaaacagaatacggacatggctgtggaccatgaaaagggctttcagatgcaccctaggactttgggtttatttttagatttgaaaaacaaattttaggccaggcacagtggctcacacctataatcccagcactttgggaggccgaagcagaaggattatttgaggccaggagttggagaccagcctgggcaacatagcaatactccatctctacaaaaaattaataaattagccagacatggtggcttgaggccaggagtttgagactagcctgcgcaacatagcaagaccatgtctctacaaaaagttaaaaaaattagccaggcatggtgatgtatgcctgtggtcccagctactcaggaggttgaggcaggaggattgcttgagcccaggagactgtggtgagctatgatcataccactgtactccagcctgggcaacacagaaagactgtctcaaaaaaaaaaaaaaaacttgaacctgaagtgttataagatcaggaaacctgatttaagaaaagtcttccagattagactgtctggcagaacaaaggggtctgggaagaatgacagcatgactgaagggctccgtctggaaaggaaggaaggtgtgccaccaggagaaggcagagccaccccagacaccaacagctgagacaatcccagccctgggttcatggcccaaagtcacagcccactcaccaaccccaaaaacataccccctgtgacatgtggctgagcaccagacatcttcctctcaccttgctgaggataccttgctgctgggcaggtgacaagtcggatacatactgggagacggcacttctcaggacctgcgagatgtccttgcgtttcatgctgcagaaggcctgggtgctgaccccagccagcagtgcgcccatctggctgacattgtagaaagacagcacctggaagaggagcggctgcgcagtcaggctctgctcccgcctttcacctctccaacgtgcactcagcccatctatgtgccaagtatagggatgggtgacaccttaggggcacagcagtgagccagacagatgctgcctccacaggccttccttccttctatcaagaaagagagttggccaggcatggtggctcacgcctgtaatcccagcactttgagaggccaggcgggtggatcacctgaggtcaagagttcgagaccacctggccaacatggtgcaaccccatctctactaaaaatacaaaaattagccaggcatggtagcaggttcctgtaatcccagctacttgggaggctgaggcaggagaattgcttgaacccaggaggcagaggttgcagtgagctgagattgtaccattgcactccagactgggcaacaagagcaaaactctgtcagaaagaaaagaaagaaagaaagaaagaaagaaagagagagagagggagaggaaagaaagaaagaaagaaagaagagagagagagagaaagaaagaaagagagaaagaaaggaaagaaagaaagagaaagaaagagagaaagagagaaagagagagagaaagagagaaggaaagaaagaaagaaagaaaggaaggaaggaaggaaggaaggaaggaaggaaggaaggaaggaagaaaggaaaagaaagaaaggaaggaggaaagaaagaaagaaagaaaaaagaaagaaaggaaagaaagaaagagagagagagaaagaaagagaaagaaagaaagaaattatacttgggttttttttccttcctttagagtgaagatgctagatagttttccatataatcaaggacatgctttggttctatgaaaagacagctgagtgggttcctttagttattctgtgtataatgggtgatctcatgctgtcttcaaagaaggcaagaccttttgacctcttgccttctgagtaaaagtggcctcacccctcagtaggaagagttgggtattaggaaagagacaaaccactttgtcctgggctgggagggaacaaaaccgtctccctcaactccctaaaatcaaattcagagaggactgtcaaggtggacccatggagccccagtcaaggtccagaaacaaggattcaaagccttcaacataaagtcaccacgaggctagaagagaccagatgaatgggctggcctggtacctgagtcagaaagtgggagtgcgtgggcattggtcatggtgccataatggagacagtgagcacaggagttaaacaagatggctctgaggccaggtgccctgggttcaatcccagctgcgtaactttcacgtggccttttccagttcccttacacactctgtacctcacatgaatgaactggaaaatgaagactacagcactactgacttcagaggattgttggattaagttattaattcacttagaacacaacctggcacatagtaagtgttcagtaaatgtttgttattccacaccctccctcccttggccccgcgatggaggaagcaggctaggaccagccctcggagctgcagctgcccttcatccctccctcgccctctctaccgacatcctgctccagttcccacttggatttactttggggaatgtggttggaatatatctggctcagaaccatgacataccaaacccagctttaaaaacttgaagaaatttaaaaagacttggatgccaagaagaaattccctactccttctctttgggaggccaaggcgagtagattgcttgagcccaggagtttgagatctgcctgggcaacattgcaaaatcccatctctacaaaaaaatacaaaaatcagcccggcgtagtggcatgtgcctgtggtcccagctactcaggaggctgaggtgggaggatcacctgagcctggggggtcaaggctgaagtgagccaagatcagatcacttcactccagcctgggcaacatagtgagaacctgtctcaaaaaacaaaaaaagaagaagaaaccccccagttcctgaggccaactccagcactgccttctggatgcatggattctactctataactcttaaacccctttaccgcctgaatcaaaagcttttgttttcattttaccacctgaatcaaaagcttttgttttcatttccaacctcagtgatgcgatctcggctcactgcaagcaccgcctcccaggttcacgccattctcctgcctcagcctcccgagtagctgggactacaggcacccgccaccatgcccagctaattttttttttttttatttttagtagagacatggtttcaccgtgttagccaggatggtcttgatctcctgacctcgtgatctgcctgtctcggcctcccaaagtgctgggattacaggcgtgagccatcgtgcctggcctagtgattttcttccttgtgagacactgtggtattttgctttagaacaagcaaaatggggccccttacattttcaacatcttcacctcttcccatatcctccttcaagctgcatgggaggtactaacactagaattacggtgctaggttagtaaacatgacctttaaggagtagtctctcctttattctttgggattcctactacttttttcttttttttttttaagacagagtcttgctctgtagctcagcccagtctggagtacagtggcatgatctcggctcactgcaacctcctctgcctcctgggttcaagtaattcttctgcttcggccttccaagtagctgaaattacgggtgtgcaccatcatggccagctaatttttctatttttagtagagacagggtttcaccatgttgtccagctggtctcaaacccctagcctcaagtgatccattcatcttggcctcccaaagtgctgggattacaggcataagccaccatgcccagcctactaccttttgtcaaaataaaaattgatgagttttgtatagttggtcagacacagttaaaactaaattcacagtttagcaattataatgggtgcttgttaaacatctggtagtaaattatgttgtttcaaagtaattaaaattaatatccagaagccaaaaataaacaaatgtttgttattattatttgattggaatgggtcctaatccaatccttgtgagccagtttgcatcctgggaagtggccaggagtgtggactaaacgagaaggacaccaaaagccaggcacggtggctaatgcctgtaatcccagcactttgggaggctgaggcaggcggattacaaggtctggagttcgagaccagcctggccaacatggcgaaacctcgtctctactaaaaacacaaaaattcgctgggtgtggtggtgggtgcctataatcccagctactcggaaggctgaggcaggagaattgcttgaacccggaggcggaggttgcaatgagctgaggttgtgccattgcattccagcatgggcgacaagggcaagactccgtatcaaaaaaaaaattagatgacaccaaaatgcttagaactcaagtctcccagatttggagccctctggactggacccaacccagggacattaattgtccccaaaagaatgtccattttccaccccaggagcagcaagaacacagattaagactcctgtccccaccaaagaggactgtctgcctgacagttccctctctgcagcccaagattggaataaaatagcatcatccctaatcccaaagtaatggcaaaaaccgcaattactttttgcatcaacctaatagcagcttaacagcaggcaggaaaatcctgggatgagtcccacacgttgatcccactcagggatggctaatgccccttgagctcctactctgtggtgtcacctggtggtctagcttcttcatgtgtaccaactcacataatattcgcagcaatgctacaggataagtgctactgatttgttgttgttgttgtttaattttttttgaaatggagtcttgctctgtcgcccaggctggagtgtggtggcacaatctctgctcactgcaacctctgcctcccaggttcaagccatcctcctgcctcagcctcccaagtagctggaagtacaggcatgcaccaccacgcccagctaatttttgtatttttagtagagacgggatttcaccatgttgatcaggctggtcccaaactcctggcgtcaggtgatcctcccacctcagccttccaaagtgctgggattgcaggtgtgagccaccttgcccggcagtaagtgctattgttgtccacatattacaaatagagaaactgagtcaaagtgaaaatagcaaattgcctagtgtcacacagctagtaaatggcagagcaaggatttgaacccaggcagtcctcctcagcatcatcttcttactgattggttgccccctgctgtgtgtgtataactgattgttatggattaaatatttgtgtctcccaagaattcatatgtcaaagtcctaacccctaatgtgatggcattgggaggtgagacctttaagaggcctttaagggttagatgaggtcatgagataatgagggtcaggtggggccctgatccaatgggattagtttccttgtaagacgcaacaccagagagcttgctctcatgtggtcaggtgagcacacagcaagatggcggccacctacaggccaagagaagaggcctcagaatgaaacctacctttctgacacctcgatgttggacttcccagtctccagaactgtgagaaataaatttatgttgtttacgtcactcaatctacagtatatttttatggcagcctggcaggtctaatacacttaggtcatcttaggggaataaaaaagagtttaaaactccagctgaccttctcatgggccaagtatttggcagacaagatgatgacctggctcttggcccaacctgagacctggttgagggtggagatggctccgtgcacagcctcgggggagagggattccagttggctgtaggtcaaacctacaactgcatccgacaaagaacccagggtctcattgagggtctggttctccatggcaatgtccaggagttctgctttgagctggaaggagagcaaactggaatgagtgttgacaggaagcagggcggtggctccctctgaccatatccagggctattaggactccacagcacctcccttgaccctgttccatcaaagcttttgggctcagaaacgatgaaggaaagggactcctgccatgcccagacagtgagacaccacacggaggacacctcttctggccttagctttcatgtgccaaaaattccctttgtacttcatttaaatattaatttgttattaaatcaaccttaatccatgtcagaaagaaatgttccttttataactacaccacactcttatagcatctgttgtcctctggtgaccttgaactctatatccatatatacaggctgttttcctttcattaaatagccaggggccttttcacgataatttataatctgtgtaaaaataacttttttttttttcttaagacagagttttgctcttgtcacccaggctggagtataatggtgtggtcttggctcactgcaacactgcaacctccaccttccgggttcaagcgattctcctgcctcagtcttctgagtagctgggattacaggcacccaccaccacactaatgtttgtatttttagtagagacagggtttcaccatgttggccaggctggtctcaaactcctgacctaatgtaatccacatgcctcagcctcccaaagtgctgggattagaggcatgagccaccacatccagccaaaaataactcttcacagtacaagaaagtaaaagtctcctgaacatcctaccacataaaaataaccatgattagcaattgggtgtatatgcttccaagatttcttatacctttataaatatagagacactacatagtttttacagagttgtaatatgaacagaagcacaatttactcttcttaaaattatctcttgcacctctttgcacatttctatgatcattttaataattattttattgcaatatgcctgcctaatgatagtaaagtgtgcgttacagctgctttcggtaaggaatgtgataaagtcacctactatacaatgagctctgtaacaaaaaacaagaatggttcatattttaacacccgaatttacgtaataacgtagtcatttcaggcaggtgcacaaaacgggtttctggcaatattgaaatagccactggggggcagcagagtgaagtagaagaaacaactgtcaaagcgcctgggttctctaagttcggcaactgccttacctagaaatcagtttccacatctgtaaaacgaaggggtggactacagtggcagctcccaaagtgtggagcacacccagcggcatctgcaacacctgggaacttgttagaaacgcagattgccaggctgctcccggacctcctgaatcagagactgggtggggctccgaaatccagggatccccagactccgggtcacagatggggaccaccgggaccctggcctgttaggaaccagccacagcaggaggtgagcagcaggccagtgagcattaccgcctgagctctgcctcctgccagatcagaagcggcattagattctcctaagagcaaaccctattgtgcactgtgcatgcaagggacctagtctgtgcgctctttatgagaatctaatgcctgatgatctgtcactgtctctcatcacccccagatgggaccgtctagttgcaggaaaacaagctcagagctcccactgatttcacattatggtgagttctatagttatttcattatatattacaatgtaataatagaaataaagtgcacagaccgggcgtggtggctcacgcctgtagtcccagtactttaagaggccatggcaggcggatcacgaggttaagagaatgagatcatcctggccacatggtgaaaccccgtctctactacaaatacaataaatagctgggcgtggtggcgtgcacctgtagtcccagctactcaggaggctgaggcagagaattgcttgaacctgggaggcagaggttgcagtgagccaagatcgtgctaccgcactccagcctggcaacagagcgacactccatcaagaaaggagaggagaggggaaggggaaagggatgggggggggagggggagggagggagggaaggaggaaagaaagaaagagagagagtgagaaagagaagaaagaaaggaaggaaggagggaagaaagaaagagagagacagaaagagaaagaaagaaagaaagaaagaaagaaagaaagaaagaaagaaagaaagaaagaaagaaagaaaaggaaggagaaggaaggtagggagggagggagggagggaggaagggagggaaggaaggaagagcacaataaatgtcatgcacttgaatcatcctgaaacaatcccccggccccagtccacggaaaaaaattgtcttccacaaaaccggtccctgatgccaaaaaattgtcttccacaaaactggagcgctgccacaagctgtatttgaacaggccctccctgtgatttagatgcaccctccagtttgagaacaactgagctagatgatcccaaagggctccctcgtatctaattgcatgccaccttctccttggtcagggctgccacatgttgagacccctgggccttaaaatacatttatcttcttatttttgcttgagcttgcttaggacggattcttttccttggaaacaaaaatatgcattcacaggctaggctcggtggctgacgcctgtaatcccagtactttgggaggccaaggcaggtggatcacttgaggtcaggagttcaagaccagcctagtcaacatggtaaaaccccatctctactaaaaacacaaaaaattagccgggcatggtggcatgcacctgtagtcccagctactccagaggctgaggcaaggcgaaggttgcaatgagctgaaattgtgccacttgaacccggaaggtggaggttgcagtgagctgagattatgccactgcattccagcctgggtgacagaatgaaactcaaaaaaaaaaaaaaaatgaatcttataaaaaaaaaaaaaaagatgcgctgaccaaaatagatgaccacactctcaaatgtcaaatgtgtttggggactttatggtgatgtgtgggaaactgctgtgaaattattgatggctttatcaaaatttcatttaatattattttcatgtcatcgtttcgattttaagcaaattgaaaagggccacaaaaagtggaatggaagggggtagaattgagacttgactggaaggaagaagagagagatggagaggaaggaaaatgagagagagcgtgtttgctcatctggtcttgggaactcataaccaccctgcaatccagtgttctcaatcctggctgcattgaaatcacctgagaagcattaaaatcaggccatacctcaggccacaccccagaacaataacatcagattctctgagggtggcacctggcagggatgttactaatctagaggcaggtttgagaaccactgctttatctcctgccgctccaggtgtgctcaccagagcagcggttccagaatcacctggaagcttgttggaagtgcagcgtcagctgggcgcaatggctcacacctgtaatccaaacactttgggaggccaagggaagaaggaggaagaagaggaagatgggagtcctgggcctcaaccaagagctcctgaatcagaatctgcatttaagatccccaggtgatctgtatgcatatttaagttcgaagtagctgtccctttcttttcttttctgttcttttttttagatagggtcttgctctgtcatccaactagagtgcaaagtcactatcatagctcactgcaggctggcactcctgggctcaagcgatcctcctacctcagcctcccaagtagctggcactataggcacatggcttttttttttttcttttgagacagagtctcactctgtcacccaggctggagtgcagtggcacgatctcagctcgccacaacctctgcctcccaggctcaagcaattctcctgcctcagcctcctgagtagctgggattacaggcgcatgccaccacgcctgtttttgtatttttagtagagacagggttttaccatgttggccatgctggtctcaaactgacctcaggtgatctgcctgccttggcctcccaaagtgctgggattacaggtgtgaaccaccgtgcccagccatttttttgtattttttgcagagacaagggtctcatgatgttgaccaggctggtatcaaactcctggcctcaaatgatcctcccatcttggcctcccaaagtgctgggattacaggcatgagccaccgcgcctggctgagacagctttctgattaaattttgatctccccagggtctgttcctttgctattttctgtctgggcttcgatgttacacttacctcagtatttgagatgccatctgctgtgactggacttaaatcccgactaatgctgtgtgttttctcccaaaggctaagctaggctgttctccccatttctctggctagtgacactgaggcagaggcctcagggccttgcaccccagctgtaccttctggacgccagcctggaagcccctcaggtggctgcacttgatcatctggtaaagcaggacttgagccacagtggcatccagcaattccaggtcattgtagaaacaaaccagcagccccagcctgtgtgagaagaggagggatggtggtggaggtgtaaccgcagaaccagcccattctggttcaattttgtgtaataaaatggtgagttgtttttcagttgccacggactcccaggttgaaggtcacataacctgaacatcctcagatgaaccaaatgtgcaaccacaggcggaacctaactgctcagacgagaccaaggaatgggggctgaattatgaagtggacaccacatggcatggtccacgatccaatcagaatgagtcctggcatcacctcatggcatgatccaatcagatcacacctcccagcatcaccttgtagcaagacccaatcagatcaagtctcattaccctccgcctataaaacctgccccagtccccagctcagagacacagatttgagcactgtcttctgtctccttggcagttgattcacagtaaccgtttctctctacaaaaacctagtgcttcagtgtttggttttccattgcgcatgggcaaacagacccagtttggttccataacagagcgctgagagctggtggacacgacaccccctccccagtccaaaccaatggggtcttgattatattaatagcagctaccacttatcaggtcttgcactgagccgtttacctgcattatctcattacagcaaccctacaaggcaggtgctctcattagccccatttcacagatggggaaactgagatttgatttgtccaaggcaagtcggtggagctgggacttaaatgtagatccatccacctatgccatctctccacctgggatgaataaagggaataaggaaagaaaggtgccggtagccacagaaaactccccattttccacattacaatcactaaattctagagctgatctcaccctgagggattctctgaggcagagatctgtttctaggatgccttctggtacccacccagatgatgcaaagatttcagaaggaaaacaaaaaagactggaggaaaacaatggaagggcagaagtgagattggaaccctggtataactgagagcaatgtttctaatcattaagagcattgattcaggcctactgcagtttgaagcccagctctgtgagatgtttgctctccaccaagttacttaacttctctgtgaggccgctatacacagttctgcagtgcacactctgtactcccatactgtacagagacagggtgcctctccctctctgagcctctaataaatgggaggttttctttgttcatcgtagcacatcataataaacatgagtgaaagaaagaggatgattgtgaaagttaaatgagaagtggtataccaactgatttgcatacatcctggtggaaaccaagcactcattcattaatgaatgctcttagagttagaatgaagactacctagttgaccacagtcagcctggctccaccctctcagagcgatattgacatattcagacatgcccacaggagagctgccaggtccagggaaaagatttgaaagtgtgtctcatgaggaaaagagatctgcttaacttcgagtaaagaagactcaggggaagtgagggctgaacgttaataaccacgttgagaataactattcacaacagccaagacatggaatcatcctaagtgtccaacacgtcagtggatgaatggattttttttttaatttggtggatacacaatggaatgctcttcagctttgaaaaagaaggaaattctatcatatgggaccccatggatgaacttggaggatcttatgctaagtgcaataagctaggcacagaaagacaaatactgtatgacctcatttatattatgaatctgaaaaacaaataaacaaacgtcatactcatggaagcagagccttagaatggttggtaccaggggctggaggtgggaagggagttggagagacttggacaaaggacacaatgtttcagttaaataggaaaataggttctggagatctattgtacatgctgactacagttaataacaatgtatcatatactcaaaaattgctaagagtagattttaagtgttctcaccgcaaaaaaagtatgtgaggtaatgataacttaattagcttgatttagccattccacaatgaatatatatctcaaaacatgttgcacaccatagatataatttttatttatcaatttaaaaaaataaattataaaagaaaaataggcttggcgtggtagttcatgcctctaatcccagcactttgggaggccgaggcgggcggatcacaaggtcaagagatcaagaccatcctggccaacatggtgaaaccccgtctctactaaaaatacagaaattagctgggcgtggtggcgtgtgcctgtagtcccagctacttgggaggctgaggcaggagaatcacttgaacccaggaggcagaggttgcagtaagccgagattgtgctactgcactccagcctggcgacagagtgagactccgtctcaataaataaataaataaaaagaaaaaatattattcattgagcacttactatgtgtcaagtgtgcaaatccctacaaagaccttaatgcagtaggcatatttttatctcccattttacagatggggaagcggaagtatagagaggtgatgtaaaaatagcaaagatcacaccattagtaagcagcagggaaggattaagccacgaagtctggctcgaggtcccatgttcttaatcatgaggctatttttgtgtgtgtgaaaccatagaaaaatgagacacatgctaataagtgaaaattactaaaggtaggtgaaacagatgtaattgtttcctatgagtacattccctaagagtggctcatttgaaaaaccttaaggtaatatgggatgggagcagtgtggcaataataagaccttgagagacggacacaagaggattgaatgatggcccagcacagtggctcacgctgtaatctcagcactttggaagtccaagatgggtggatcacttgaggtcaggagtttgagaccagcctggccaacatggcgaaacccagtctccactaaaaatacaaaaattagctgggtgtggtggcacacgcctgtaatcccagctacttgggaggctgaggcaggaggatctcttgaatctggaggtggaggttgtagtgagctggtattgcaccactgccctccagcctggacaacaaagtgagactctgtctcaaaaaaaaaaaaaaaaaacaggattgaatgggccaggcgtggtggctcatgcctgtaatcccagcagtttgggaggccaaggcaggcagaccacctgaggtcagcagttcaagaggtcaggagtttgagaccagcctgaccaacatggcaaaaccccatctctactgaaaatacaaaaaatttagctgggcatggtggcacacatctgtagtcccagctactctggaggctgaggcatgaggattgcttgaacccaggaggtggaggttgcagtgagccaaggtcacatcactgcactccagcctgggtgacaggacaagactctgtctcaaaaaaataaataaataaaaggaaaaggagggagtattgagctgtactcaccacctccttcccattgcccactcccttcctgacacccctggaatgtagagttcctgtccctcctcccctgctgggaatggttttagggaggatcacattacagtcactaaattctagagctgatctcatccaggggctccccagctaagagtctgataacaagtggttctcatatatggggacccatgagttatttccaacacttgactcaacttaaacggaaatcacacattcactttggaacaggacccagtcctgagtatttaaaatgtttcatttctgtgctgagagacagaattagcacttgataaggttgcataaaatgcctggcacacaggagatgctcagaaagcatttatcctttcacccagcttcataacctcttcataaaaaaagttgcagacacctctcctcacatgcacagagaaatatgggactattcaaagagatggaccagccacctcccttccctccctgggtgttttgctgctcagagaattctgatgcttagatcacatcttgggaaagggctccaaggcccagagctcatgcgcttgcctgtggatggtggaggtattcctcatgttaaagttggaggagctgatcctctccagaaacgcctgggccagctcaggtgtgatgtcatagaccatgtccagctgcttggtggcgttgtcatagctgataaacagcccaatctagttggtggacaaggacgagaatatcagtgaggagggtggaagtggcccagtgtggccccaccctggtggtctgcactgtgccccatcatggacacttggatacacctcctggttctcattgtcattgatgtctttttttcttttctttttttttttttttttgagatggagtctcactctgtcgcccaggctggagtgcagtgacatgatctcagttcactgcaacctccacctcctgagttcaagcaattctcctgcctcagcctccggagtagctgggactacaggtgcccaccaccacgcttggctaatatttgtatttttagtagatatggggattcaccatgttgtccagggtggtctcgaactcccagcatcaagtgatccacccgcctcggcctcccaaagtgctgggattacaggcgtaagccaccatgcctggcctcattgtcattgatttcttagtggtctgtaactgctactttagtttcctcctcaacctaactattctttaggaaagaattattttttaatatctgagaaactgggctttttaaaagctaatctttgcacatttatttctagatttgttatatggaggtcagagaatgtggtccacaaactttctgctttgaagaatcagaatttttttaatagatgaatgagtttataaatggcccttgggtgatggaaaagagtatgtgttctctttgtaagacacaaagtttggtgcatatatattcaacttattaaatatactattcagattcccaacattcttgttcctttttggcccacatgtccaagggtgccacgtgcaagtcttctactactacaggactcatatctatctattcttccttgtatttctagcagattataaattatatatataattttggggggacactgactcactctttttattttatttttgtttttatttttatttttatttttatttttttgagatggagtctcgctctgtcacccaggctggagtgcagtggcacaatctcagctcactgcaacttcagcctcccgggttcaagtgatactcctgcctcagcctcctgagtagctgggattacaggcatgtgcaaacatgcccagctaattattgtatttttagtagagacggggtttcgccatgttggccaggctggtcttgaacacctgacctcacatgatccacccgcctcagcctcccaaagtgctgggagtagaggcgtgagccactgcgcccggccaagacacagtctcactcttttacccaggcttgggtgcagtggtgtgatcatggcttattgcagcctcgacctcctgggctcaagtgatcctcccacctcagcctcccaagtagctgagacctcaggcacacaccactacacctggctaatttttaaatttttttgtagagatgaggtttcactatgttgcccaggctggtcttgcacttctgggctcaagtgatcctcccgccttggcctcccaaagtgctgggattactggcatgggccacggcagccggcacattctatattttgagacagtattatgctgtgctcaaaggggctcataaagttgtctctcctttgtggatcgtactctttgtccatataaaattcctttttaggctgggtgcggtgtctcacacctgtaataccagcactttgggaggctgaggcaaggcagatcacctgaggtcaagagttcaagaccagcctggccaacatggtgaaacctcgtctctgctaaaaatataaaaattagccaggcatggtggcatgtgcctgtaatcccagctactcaagaggctgaggcaggagaatcaattgaatctgggagaaggaggttgcagtgagctgagatcacgccactgcactttagcctggacgacagaacgagactccatttcataaataaacaaataaaataaaataaaattcccttttagcagtgttattcttgacttctcccttctctacatttttagcgaataaaaagttgcaaatgagtgcttgaccttagaaatttcctctagggggctcagctttctaagaatttaagctgttacctactcaaagcaactctacattgagagagtaaatggcagtggggtgcggggttaattctaggactgcgggttataaaaatcggaagacacttgaaatactcccagccccctaggtaaaagagagaaagctcgttctgcctctggtttcataataaccacacattgctgggtcaatgggtccttgaacaggccagtcatttgatgcaaacacttctctcactggccagaagagtcagggcacatatgacttaaaaaagaagaagaagaagaagaaaaattggaagcaaggcccacagtctcttcatgaatccctttgtgttggcagcattctttggagaccgcattcaagaatcatgatgcccaagggattttagtgtcattgggtcaacatcaaaaggagagggacaggttgactagtgagttaagtaatcctagaatgtgtgtatttctccactgtaaactctagaattaaaatctaaccattgctcatgctcaagtagctattaacagaagtagctataaatagaagtagctattaatccattttgcttttgctttgagttcatgatcccaaggatgggaaactttatatcttttgtccttggccttctccagtacaaaaatacccttaaatgatttttggttcatagccaacaatccctttaaatcatgtttgctcacatcagagatgtgatcttagttgtccacaattctttttcttttcttagcccttccacactaaaacaatcccatgactgcccacttgaaactttcttccaatagttttcttcagaggcccaaggtctattgggctgaggagggtacacaatttccaaggcaccttgactggctggatgaacattagagtttgagaatacaccttaccccaagtgtattagtaatggtgacatataaatgtacttttccaacttacttctataggactaattttcgtaatttcttcaaacgataggtgaaccatgtatctgcccaaaacccataagtgttccgcactgacccatgaagcagagtcatctacaaaaaataaagaaatgaataaatgagtacatacataaataaaagcctttacactggtatgtgatagtcaacagcatctttgctgtcaagacctacttcttgcattcattaattcgttattttgtttttcggggttttttgagacagaatctcactctgttgcctaggttggagtgcagtggtgtgatctcagctcatctcaacctccgcctgccggttcaagcgattctcctgcctcagtctcccaagtagctgggattacaggcacccaccaccatgcccagctaatttttgtatttttagtagagacagagtttcaccatgttggtcaggctggtctcaaactcctgacctcaggtgatctgcccgcctcttgcctccccaagtgctgggattacaggcatgagccaccatgcccagccacattaatttgttattaactcattcaacaatcatatacgtagggcctacctgtgagatcacacgtaggatgtgaacacagattcgcaccacctcagaccttgttactcaatagtgtggtctttggaattgcaacatctgtgtcacctggccacttgttagaaatacagattattctttctggccaggcacctgtaatctcagcattttgggaggctgaggcaggaggattgcttgaggccaggagtttgagaccagcctgagcaatatatcaagaccctcatcgctacaaaaaaaaaaaaaaaaaaaaaaaaagccagctgtagtcccagctactcaggaaactgagaagggaggattgcttgaaaccaggaatttgaggctacagtgagctatgtgctcactctactgcactccagcctgggcaacagagtgagaccctgtctctttaaaaaagtaataataattaaaaataaataaataaataagaaatgcaggttatttttaatacttaaaacccacaaaatgtagttttattttttcattcgattggttactaaataatctggaaacatgaggccagatgtggtggctcacacctgtaatcacgaaatcccgtctctactaaaaatacaaagaaaaattagccaggtgtaatcccagctacttgggaggctgaggcaggagaatctcttgagcccgggaggtggaggtggcagtgagccgggatcacatcactgcattccagcctaggtgacagagcgagactctgtctaataataataataatgataataatctggcaacatgaaatatgtttgactgtcttgcatcactaccactagtaaggatcatcctcactgattatcaccatgttactatacttgaaccaaagcaaactacttgtacctccccaaaacattctccaaatcttggctggccttggccctgctcaccacctacaatgcttttccttaccccttctgcatccaaatcctactttaagatcaagctcaaattttcctctcccttaaagccttctcttatctccttcacgagaagtactttctccctccactgaattcccagaggactctctctgacaccccgttctggcttttgaaattccccatcactgagatgtcagtggaattttaaaaaccatcaagtcagccaggtgcggtggctcaagcctgtaatcccagaactttgggaggccgaggcaggtggatcacaaggtcaggagatcgagagcatactggtcaacatggcgaaaccccatctctaataaaactacaaaaattagccaggcgtggtagcgcacgcctgtagtcccagctactcaggaagctgaggcaggagaatcacttgaacccgggaggcagaagttgcagtgagctgagatcataccactgcactccagcctgagtgacagagccagactccatctcagaaaaaaaaaaaaaaaaaaaaaaaaatatatatatatatatatatatctcaagtctaggatcagacttcaagtttcactgagctggaagtggctgccaatgctccccagctctttagcaaaagacatttacacacgatattgtattggaggcatttggggaaaatgaaggaagtggggagcatttacagggtgcagtgactctaacatcaagagctatttgcagaagccgtgggcaatgacagatgccaaaacaagatggagaaatcaacttttatatagactgattcacaagaaaatatggagtgcctctcccaaaccaggaatcaaagatgttggggtgacacaggcagactcctacgatcctctagatggggaccctggacatttgccttgcctatatagagggctggaaacttttgaggctagaaccacacattcacaaagaaccaagcttagttgtttattttttaacttattactaagcataaactgtatttctgtagatcaatcatccccaagcttgggatttttttttttcttcctctgttgtccaggctggagtgcagttggatgatcatagctcactgaagcctcaaactcctgcctcagcctccctagtagctaggactacaggcacacatcaccacatcaggctaatcttttaatttttttgtatgggggggggggtctcactacattgcccaggctggccttgaactcctggcctcaagcaatcctccttcctcagccttccaaaatgctaggattagaggtgtaagcgaccacacctggccagcaaggttgggatatttttaacagccaaagtatttccagttccctcaagggccttcatgaaaaaacaatttaagtccaaacagaattaattttaactcactgtagtttaataatgaagcgcaccgtataagaattttagaaggaaagtctgtgcctaattaaactctggcaataaagacagagaagtctgaaggtagagaggctttctcatggttacccagtgtgagactctgattcctggagaccacaattatgcaccaggcagagggaattctactatgcatttgagactttgattatgatgttgtttaatgttcattatgcacaaatctcagagctgaattccaggaaaagattgattggcattccccatcctccagccccatctgctttccttatgttttccccacaccgagctcattcccgtctcagggcctttgtatttcctgggatttctctctgggatgccctttctccagagccttacgtgactggttccatctcctcattttggtcttgattcaaatgtcacccacttgagaggtcttccctgattccttagtccaagagttggcaaactacaatccatggggcaaactctgcccatcacctgtttttatacagcccatgagccaaaagtggtttttacatttattattttggacttttttttagagacaaggtctcgctctgtcacccaggctggagtccagtggctccatcacggctcactgcagtctcaaactcctaggttcaagggatcctccccccctcagcctccagggtagctgggactacaggcatgtaccaggacaccggctattttttaaaaaattttttaagaaatggggtcttgctatgttgcccaggctggtcttgaacttttggcttcaagtaatcctcctgcctgggcctcccaaagtgctgggattacaagcatgagccactgcaccctgcctgctttttaccttttttaatagctgaaaggaaaatcaaaagaagaatcctatttggtgacacatgaaaattatgcaaatttcagcatccattagtaaagctttactgggacacaggcatgctcattcatctattgtctacagctgtcttcaagctgcagcgtcagagctgaatagttgaggcagagatggtaggcttacaaagcctaaaatatttacctggtcctttacagaaaacatttgccaagcgctcttctagtctaaagtacctgtaatatcctttctgcctgggtgcagtggtttatgcctgtaatcccagcactttgggaggccaagccaggtggatctgttgaggtcaggagtttgagaccagcctggccaacatggaggaatcacatctctactaaaaatacaaaaatcagctggacatggtggcaggcacctatactctcagctattcaggagctgagagaatcacttgaactctggaggcagaggttgcagtgagccgagattgtgccactgcactccagcctgggtgacagagtaagactccgtctcaacaaactattttattttcttcatagccgctaccagtatctaaatttctaagttctctctctctctttatttacttacatgtttaaaaaaattgtctccaccaacactcccacaataaaacaatagggccgtaagagcagagactttgttttgtttccttctctatcttcagctattgatacataatgggcttttaaaaagtttattctgtttacattactgacattaaaggtttaacaaattgaagctatctgagaaattgtttgtattgctaatctatatagccattcttttctatcgctgttttgtttgtttgtttgtttgtttgcttgttttgcgacaaggtctcactacatcactcaggctggaatgcagtggcacaatcccagctcactgcaagttctgcctcccgggctcaagtgattctcccacctcagcctcctgagtagctgggaccacaggcgcacgccaccacacctggcttttgtttttttgtttgtttgttttggtaaagacagagttttgccatgttggccaggctggtctcaaactcctaacctcaagtgatctgcccgtctcagcctcccaaagtgctgggattacaggtgtaagccaccgcacttggccccaattttcttttcttttctttctttctttttttttttttttttttgagacagagtctcactctgtcacccaggatgcagtgcaattgcatgatctcagttcactgtaacctccacctcctgggttcaagtgattctcctgcctctgcctcccaaatagctgggattacagacatgaaccaccacgccaggctaattttttgtatttttagtagagaagggggttcaccatgttggccaggctggtctcgaactcctgacctcagttgatctgcctgactcagcctcccaaagtgctggattgtaggcatgagccaccatgcccggcccacctggccccatttttaagtgtagagttgagcgggagtaagtacattcacatccacactattgtgcaaccgtcactaccagccatatccagaatattttgaaccttgcaaaatcgaaactgtaccaccattctaatttctgtctctatgaatttgactgctctaggacacaaggaggctttaagcaacatccatcaaataaataaatcctgacctacctgctttggtagccaggacgctcagagttaaatttctgtgttttattgcctagatttcctaataaaattctcttctgtctctctctctttttttttttttcgagacggagtctcgctctgtcacccaggccggagtgcagtggtgcaatctcagctcactgcaatctctgcctccccggttgaagcgattctcctgcctcaacctcctgagtagctgggattacaggtgcccgccaccacgctcggttaatctttgtatttttagtagagatgtggtttcaccatgtcggtcaggctggtctcaaactcctgacctccggcaatcctcctgccttggcctcccaaagtgctgggattacaggcgtgagccaccacgcccagcctcttctctcattttaatatagatttttttatacagattttgaacttgtacccctactcaaggttcacattgaatctaagttaccatcattatttatattccactgaaaaactaggacacaacatagattatgaaatacaaacacatcattatttcagacttccacatgtgcgaattgcattgacgaaatggagtatgtgttttactccataagccacatcaaactgtttttcgaagcagtgggaggtggtaaaaatcagaagagaacaacatcaaatccatgttttcagagatgaaacacctcttctgaagatattcttcccccaaaaagtgaccccacctccaagtacaggctcaccagtggcattggaggatgtctgcagtattccagtcatccaggaatagagagctctctgggaatgagccgaggttttgtcgtagagatctttgaacactgcagatctaaatgacacaaacacaggcatcagctaataacaagcaggtgggggctgcattaaaaagggagtcacaacagcaaatgtgacccaaagctgtcttgtgttaaaacccttccctctcctggatgtggagaaatagaaacgcttttacactgttggttggaatgtaaattgattcaaccattgtggaagacagcgtggtgattcctcaagaatctaggactagaattaccatttgacccagcaatcccatttctgggtatgtacccaaaggattataaatcatgctactataaagacacatgcacacgtatgtttattgtggcactattcacaatagcaaagacttggaaccaacccaaatgtcctccaatgatggactggattaagaaaatgtgacacatatacaccatggaatactatgcagccctaaaaaaggatgagttcgtgtcctttgcagggacatggatgaagctggaaaccaccattctcagcaaactatcacaaggacagaaaaccaaacaccgcatgttctcactcataggtgggaattgaacaatgagatcacttgggcacagcaaggggaacatcacacaccggggcctgttggggggtggggggagggggtggggatagcattaggagatatacctaatgtaaatgatgagttgatgggtgcagcaaaccaacatggcacatgtatacctatgtatcaaacctgcacgttgtgcacatgtaccctagaacttaaagtatatttaaaaaaaaaaaaccttccctttcttgaatgtaaattggttcaaccattgtggaagacagtgtagcgattcctcagagatctagaactagaaataccatttgacccagcaatcccattatcgggtatatacccaaaaatatataaatcattctgtcacaaagataaatgcacacatgatcattgcagcactaatcacaatagtaaagacatgtagtcaacccaaatgcccatcaataatagactggataaagaaaatgtggtacatatataccatggaatactatgcagccataaaaatgaacaagattatgtcttttgcagggacatgaatggacctggaagccattatcctcagcaaactaacgcaggaacagaaaatgaaacaccccatgttctcacttgtaagtggaagctgaacgatgagatcacatggacacagggaggggaacaacacacactgggtcctattgtgggggtggggtgggggagggagagcattaggaaaaatatctaatgcatgctgggcttgatacctaggtggtgggttgataggtacagcaaaccaccatggtacacgtttacctatgtaacaaacctgcacatcctgcacgtgtaccccagaacttaaaaataaaaaatacccccaaacacactccttaggtatatgtaactatttttcccattttcctcttccccttcacagctaaacaccttccaaagaatattccatacatattgtctccacttcctcacctcttggtccttttttggggaagtgggggcagctctgttgagatataattcccacaccttacaattcacccatttaaagtacacaattgggccgggtgcagtggctcacacctgtaatcccagcactttgggaagccaaggcaggcggatcacctgaggtcaggagtttgagaccagcctgaccaatatgatgaaactctgtctctactaaaaatacaaaaagtagccaggcgtggtggcatgcacctgtaatcccagctacttgggaggctgagacaggagaatcacttgaacctgggaggtggaggttgcagtgagccgagatggggccattgcactccagcctgggcaacaagagtgaaactctgtctcaaaaaaaaaaaaattacataaataaagtgcacaattcagtggttttcagcatataagacaaagagccaaagatgtttctgatggcatcatttgagtctctggatccagctgcgtctgaagtcagccctacacctaaaactattcaattacatgttccaataattccctttttgcttcaagccagtttgaatgggtttttctgccacttgggcttactgcttactcaggtgagcagtaaccaataaactctctctcccaatgatgttctcttccacaatctgcatgaacggaggagggaagagatgctgaatttaaaaggaatagtataatagcctgcagagcaaaagggtttcatttatatacatcttagtgaaaaaaactggcaacctagagaaacgatgaggtcagcatactgtctgttttccttactgtcatttggctacaaaagataaaaggaatctcccacattgttatcatcatattggtcttttccttcttctaaatcatttttagatttagaaagagtgctttatggccataaagcactacgattagtaaaaggagggagttggcggtggttgcaatgcctatggcccttcaagtcctagacacaatcctcgaatttggtttacatcaaagcgcaatttcatgcagggctaggtgtaaccaatctaagctggcatggcatctcaaaaggagaagtcctcctttttcagtgctctgtcactccttctgttgtccctcaagaacaaagtctcagtttagtgccagtgaatctttaaaacacactcagattgtttttaaatcaatggaacaagacccaggctcagagcctttgtgctgtggactgaatgtttgcgtttccccaaatttcatgtgttgaaatcctaattcccaacatgaaggtattaagaggtggagttttgaggaggtgattaggtcatgaggctggatacctcatgaatgggattagtgcccttataaaagagatcccagagggcttgcccaccccttccaccacaaggggacacagcgagaaggtgccacctataaaccagaaagcgagccctcaccagacaccaagtctgtcagcaccttgatcttggacttcccagcctccagaaccatgagaaataaatgcttcttgtttactagccacacagtctatggtatttttgttacagcagcccaatctgactaacacacttaagcaagcaacatatctagctaggatttagtaacactttttttcccactgtatttatttatgtgggtttttttgtttttgttttttgtttgtttgtttttgtttttgagatggagtctcactctgtcgcccaggttggagtgcagtggcatgatcccagctcactgcaacctccacctcccaggttcaagcaattctcctgcctcaagcctcccaagtagctgagattacaggcgcccaccaccatgcccaactaatttttgtatttttagtagagacgtggtttcattatgttggccaggctggtctcgaactgctgacatcatgatccacccacctctgcttcccaaagtgctgggatcacaggtgtgagctaccacacccagcctaactctacagatgttaagcttttgctccaaaacgtgcatatcaacctgtccccacttgtcttctccctgctgccaggtgagatctctttgcattctcacggcagcccctgaaggatactgtgatgagttaagaaggtgggagtggctgggtgcagtggctcatgcccgtaatccaagcactttgggaggccaaggcaggtggatcacttgatgtcaggagttcgaaaccagcctggccaacatggtgaaactccatctgtacaaaaatacaaaaattagtcgggtgtggtaggcgcccctgtagtcccagctacttggaattgaggcaggagaatcacttgaacctgggaggcagaggttgcagtgagccgagactgcaccactgcactccaacctgggcgacagagtgaaactccatctcaaaaaaaaaaaaaaaaaagttcggaggaaccactcacaggttcttaaaggcatcctcgcgcaggtcccgagggagccgctctgtgatgtctggctggagaaagctccctgaggaccccctcagcaccttgcccaggatctccacacactccagggagttcagcatctggaaacacctctccagtgtgatgagaaacaggctgcggttcacgccagggctctgcaaggctcgttctcgaatctctcctaagtcgatgatgatgtctttcaggtcctaaagcaatgacagaagccagggtcagtttgagagctgcctctcaatttggaagccctgggagggaccacacattgcaacagtggggaaagtcaggatcactgtttaacaccatgctgctatgttgaaacttctagaactttccattccctgcagaacaaagtcaaggcctttacctgctccactcactgtggagcctccccactctccagatacacctgaccagcatacatcaggcccttggtctacctggaattctgcatctttcctttttctggtgaaatctagctcatcctttaagtctgggctccattgccatcaccttcgtgaagtctctgatccctccaacttcctacttcagatcagatttccctcccttatgtggccccagggcatcttgaaccaaactctataatgcattaaagggactcatgcgtctttcctccaagcccgtggttctcatctctgggtgcacatcagaatcacctggggagcttttttaaagttttattttatttttgagacagggtctcgctctgtcacccagtccgcagtgcagtggtgtgattatagctcactgcagcctcaacctcctgggattgagcgatcctcccacctcagcctcccaagtagctgggactacaggcacacaccaccatgctcagctgttttttgtagagatggagttttgccatgttgtccaggctggtctcaaactactgggctcaagcaatctgcccacaacctcccaaagtgctagggttacaggtatgagccaccatgcccagcccatctggggagattttgaaaaggactgattggcctggaacagtggctcacatctataaccccagcatgttgggaggctgaggcaggttgatcgcttgagcctaggagtttgagaccagcctaggcaacacagggagaccccgtccctaaaaaataaattttttaaaattagctgggtgtgctaatgcgcacctgtagtcctagctgcttgagaggctgaggtgggaggatcacttgggctcaggatatcaaggctgcagtgagctataattataccactgcactccagcctggatgacagagcaagcccctgtctctaagaaaaaaaaaaaaagcctccattttactgagcattgactctactgtgccaagcttggagcaaacgcatcatctgattaattctcatgacaatcctaccggttaagccccatgggtactagggtcaggcattcccaggttccagtcccagggcctccattatctgtgtgtcctgagcaaatgacttaccttttttaagtcccagtttttaaggtctcagaggccttgctttgtgatattcttggatcactaaactcattttgtggaaattaactgttcctgttttttgtctcccctccagaccgtgagctccttgagtgcaggaggatctctgtgtccactggtgcatagtaatttttactagtggatgtttattgacccaaacaaccaggagattctcagatccttaattaggacccgtcatttcttagtactgacaaaaatatgaattaggccaggcatggtggctcacacctgtaatcccagcactttgggatgccgaggcaggcaaatcacttgaggccaggagtttgagaccagcctggcaaaatctcgtctctactaaaaatacaaaaattagccaggcatggtggtgcacacttgtaatcccagctacttgggaggctgaggcacaagaatcacttaaacccaggaggcagaagttacagtgagctgagattgtgccactgcactccagcctgagtgacagagtgagactctaaaacaaaaataaaataaaaaattgtaaggctcttcattttaactttggagaaagtaagtgagaaaacttaggtcctaaagcccccagggggttggaggaggcagaaggagagaggaagagacaatgaagtgccaaggcctaagtcaggctccatttattcaattcaacaaacaccacgtggtgctggacttcctctatccccgggatgccaagggctcctcaccaagccgtccttcttgtcttctaagaggcatttcatggcagtgcggaactgctgggcgtctgtcttcctcaggtcctccagcagcttctggggctggtgcagacgctgctccaggtggttttccacggctgcctgtatttggggtgttgggagagtcggtgagaacagaaagagcaggagcacatggtcagcaccatggccagcggcccagcccggccccctcattccctgcagagaccacaactagtggccagcagtctggtttggccacctccaaatttcctcattagccgccaacatttaaaaatgaggggccgggcgcggtggctcatgcctgtaatcccagcactttgggaggccgaggcgggtggatcacgaggtgaagagatcaagaccatcctggccaacatggtgaaaccccgtctctactaaaaatacaaaaattagctgggtgtggtggcgcacgcctgtagtcccagctacttgggaggctgaggcaggagaatcgcttaaacccgggaggcggaggttgcagtgagccgagatcacgccactgcactccagcctggtgacagagcgagactccacctaaataataataataataataataataataataataaggggattcctcacaagatcaagatttccaacttctcttgaaaaagtaaaggtttggcaacaccgggcgcacatccccttttaggcaataattggcaagccaagggacagctgcttgttgaagtaactctcaggcccagccagcccgattcccccattccatggcctgcctggtccctgtaggtgattgagtttcccatcagcagcagctggcctttgtccaggaagtttagaaccccagatggcactgtgcccaaacccaagctaccagcgcaggagcaaaatacaggcgaaatgaacatactctgtggcgccccctacagggcaaggagcagaagccatcagcctctcctgaaagagatttcctctgctgtctggggaattgttctctaaatctccgttaaacagacatgcccagtgtgatgtcatgggcaaaaggtgaactctagacccagacaagccacatgcaaatccccaccttgacacttactagctgtgtggcttggacgagttacttaactagggttgctgggtaaaatacaggatgctcagttaaatttgaatttcgggaaaaactacacatttttttttttttagtataagtatgtctcaaatgttgcataggacatacttaacttaaaaaatcactcattgtttgccaggcaaggtggcccacacctgtaatcccagcactttgggaggccaagacaggcggatcatgaggtcaggagtttgagaccagcctggccaacatagtgaaaccccatctctactaaaaatacacaaattagccaggcatgatggcatgcacctgtagtcccagctactcaggaggctgaggcaggagaattgcttgaacctgggaggaggaggttgtggtgagctgaggtggcaccactgcactccagcctgggcaacagagcaagactctgtctcaaaaaaaaaaaaatcactcattatttatctgaaattcaaacgaaattggacatctgttttttgtttttgtttttgttttagagacggggtcttgctctgttgcccaggctgaaatgcagtggtatgatcatagctcaccgtaacctcaaactcctgggctcaagcaatcctcctgcctcagccttccaagtagctgggactacaggccacaccaccacactcagctaattttttgtttgtttgtttgtttgtttttgtagagacaaggtctcgctatgttggcaaggcttgtctccaactcctggtatcaagcaatcctcccacctatgcctctcaaagtgctgggattacaggcatgagccaccacgcagagtcacatctgtatttttatttgctaaatcagcaacatttcttctgggcctcagttttcttatctgcaaaatggaggcaataaaaggacttaccacatagagttattacgaggattcagtgtgtaaagtgttttcaatagttgctagcacacagtaagtgctcaatagtgccagctattattctctatcttgaccaaggtgaataatggcttaattaaagcctcacccctaaaatgaaaggtccttgtgggtagtatcatgactgccttgttccctactgagtcctcagtgtctagagctatgcctggcagaaagcagatgttaactcagtagatattaaatgaataaataaatatggtatatacacaggaagaaacgtatcagattaaagtggatacatctcatgagtatccattactgctagagagaaaagtggcaagcattgcttctctttcagtttccctgactgatgaagaagaaaagaaaagcagatgccatgtggggccaacagccacctccagctagtggctgtcctgggacctggcagacaacaagctctctgagtatatttgtgatatcaatgttggttgatgtttccattttcattcaaacataagtaaaaatggaaacaatgaagacatatgtcagaactttattcattaattaatgacataaatggtcttttgctaaactgaataactttctcaatactgaaagaatttttctccaattttctgtgttatccacagtgtgatgataaagacacaacatgccacactaggctaacagtcaggcaggtgctgtgcagttcaccgcagtcaccaccacaggcacgagccctattgccccttaaggcaaatatcctttgccacctatcaacacgcttgtgctattgttttcattacagtagtacatttcttggacccatggtagaaagactgatcactatatccaaatatccactctctcactgctctttatcaattgaacccttcaacttttagttgggtacatggctcctttgcagtaagatgtgactatggtgtgtgagccaatctaatgtgtgcagagggaattgtgtaacttgcgtcatatcctcagaagagaagatgctacccttgtcttcttcttcccacccatcccctggattggagaaaggaagaggtgtttccaccacatgggcaataactccccaggagatgacaaagcaaaaagataaaaggaacctgggtccttggataacctcatggaatagagctgccttttctctgtggctttcccacttagctctggactattgtacgagaaagaaataaactaaattgtttgagctgctgtcatctgggggtctttttgttatagcagctcagcctatatcctaatataccatgtctccatcaaaggtgggaaaatgaaagaaagacaaaatagcttatatcatgtttcaagaaaaactggacagaacccttttccttgcagaagcaaagactatctctacatccagcccacttctccaacttacctggcccctgagtttgcaatccctgagcactgagatgggaacatatagatgggtctcaggtacacacctgcaggctggggatggtgaaggcaacattccgggaattcagataggccaggactctgtgggacaggtcatccgtccacacgtgggagcttcagttgaagacagacaggaaaagatcacaatgacagattctcctacaagcactactgtactagctaagtgcccaggggacaggtagggatggaccaggggtgttaggactttgtacttggaagtgggaggtttctcttttcttttctttccttttttcttttctctttttttgaaacagggtcttgctctgttgcgcgatcacggctcactgcagcctcaatctccccagcccaagtgatcttccaacctcagccacccaagcagctgggatcacaggtgcatgccacaacacccagctaattttttgtagagatggggtctcactatgttgcccaggctggtctcaaactcctgggctcaagcaatcctcccacctctgcctcccaaagtgctgggattacaggagtgagctgctgcacccagcctgaagtaaaaaatttcttaaccaggcacagtgataggatagtttccaattctaggaatctgcctggatcccattctctcaaagccaattcccaaatttctaagctgtatgcaatattctaattcccgtaacaatctgcttagattgactacaatccaaactgattgtgttagaaagatgtacatttaaaagcagacgctaggtacaccatgagaggctggaatagcatagttaggagtgtgggctccaaactggatttgaatcctagttccatcacttagttgtgtggcttgagacaatttgataaattttcttgtgcctcagtttccctttatatgaaatatggttaacaactgtgagattaaaatttgttcacacatgaaaattgcgtaagactgtgcccaacacacagtaaatgcccatgaatagccttttctcatttttttttttttttttggagacagagtctcactctgttacccaggctggagtgcagtggtgcaatctcagctcactgcaacctccgcctcccaggttcaagcgattctcctgcctcagccttccaagtagctggaattacaggcgtgcaccaccacatccagctcatttttctatttttagtagatactgagttttgccatgttggccgggctgggctggaactcctggccttaagcgatcctcctaccttggcctcccaaagtgctgggattacaggataagccaccatgcccagcctatgaaaagccttttgtaatcttacgtttgcttctttgtttgtttgtttgtttgttttgcgatggagtctcactctgttgcccaggctggagtgcagtggctcaatcttggcttatcacaacctcagcctcccgcgttcaagtgatcctcctgcctcagcctcctgagtagctgggactacaggtatgcaccaccatgcctagctaattcttttgtacttttagtagggacagggtttcactatgttggccaggctggtcccgaactcctgacttcatgatccgcccaccttggcctctcaaagtcctggaattataggcatgagccaccgcgcccggcctgtaatcttataaagagatggatggatggatggatggatggatggatggataaattaataaacaaataaaatacttagactgaaagaatatatccaaaagtacccattggtgttatcttagggaaaggagtggttatgggagtctttcactttaacataactgggtatccctgatatgaggccccaagacccctatttcttatcgatcatagtactcatcatattagaattgtttattaatattggcgtttccacactacctagttccctgccccatgtccctggtatctgtctgtatgcagcttataatgcaacagtaaagggaatgggtcctggagccaggccactggttcacatcccagttgtgtgtccttgatttacccttcctggacctcagtttcaccattgtgtgcaatgggataacaatgggaactacattgtgtggcacttgtgaggattagattgtttctataccaagcgcttagtagaatacccactacatagaaagcactcaataaatttcagctcttaggccggttgcggtggctcacacctgtaatcccagcactttgggaggctgaggccggcagatcacctgaggtcaggagtttgagaccagcctggccaacatggtgaaaacccatctctactaaaaatacaaaaattagccgggcatggtgacaggtacctgttaccccagctactcaggaggctgaggcaggaaaattgcttgaaccccggaggcagaggttgcagtagtgagccaagatagcaccactgcactccatcctgggcaacaagagcgaaactccattcaaaaaaagaaaaaaaattggcccttatgctagagtgaggaggaatgatgcccgtggagcaagggtgtttgttgacttttaacacattgtgcattgattgacattttttgtaatgagcacatattactttttacaattaagagacttccattaagaatttttattaaaaatctataccatcccttcccctctcctctagggcattttacctttgaaactgtatgagatccagcagtgctacaatgggagtaaaatgaaaagacatctttaaaaggaatcattccagagagatcacagctacattctgtttgaaattcttagaagaagcaagtggagatcaagggggcacattaccattcagatagcttccatctattatttcttcctaaaaggcaaagagataacatcaagtataacaaccaaaagttggcaattccagtagaggggactctgattaacagaaaatagaatactcaccgccatgttttgcaacaatggatgcaaatctgtaagaaagccattgaatgtataactagaattgaattgtgtgaccttcaaaactacaaatatgggttagaggaaaagccccagaaagccactcatgaaggaaatttttagtgaattttaattataactgtccactctgagaaaaccgtggcttgaaaaatcctcttagaataatcctgaaaaatcatacatgcacacacacacagcccaaaaacaacttacagcatcatgtacctaatgtatctatcccacctcattccctaaactgtgtggaaaccacaaagggtgattcttccctcaggacttaccctgcctggaatttggcactgtataactcgacactccatggctcagaaaaaggaataggaaaagggagtatgtcgtaggttcctgagacattctcctgtagttaatttaagcatagaagtgattcatgttttttttatatatatatatatacacacacacacatatatatacatgtatataaacatatatatatatatggacattcagaagacaaaaggaaaaaccaagtacacccagaatcccttgaagtcttttttaaaaataattttaaaactcacctactttcctccatctaaacccccattcttgtctaagacactatcatctctctccttggtgactacaatggcctgtttatcttaccactacccccaactcctctcaatccagcaaaaaggtatagtcaaaagtagactctgggccaagcatggtggctcacacctgtaatcccagcactttgcatggccaaggtgggtggatctcttgaggtcaggagttcgagaccagcctggccaacatagtgaaaccctgtctctactaaaaataaaaaattaactgggtatggtggtgcatgtctgtagtcccagctacttgggaggctaagacaggagaagtgcctgaatctgtgaggtagaggttgcagtgagccaagattgtgccactgcactccagcctgggcaacagagcgagactctggaaaaaaaaaagtatagactctattttatctgcaagaaatttatatccagaatacaaaaactactcttataattcaataagaagatagacaagccaaggggaaaaaatgttaaaaagatatgaagttggccaggcgcagtggctcacgcctgtaatcccagcactttgggaggctgaggtgggcggatcatgaggtcaggagatccagaccatcctggctaacacggtgaaaccccgtctctaataaaaatacaaaaaaattagacgggcgtggtggcgggcgcctgtagtcccagctactcaggaggctgaggaagaagaatggcgtgaaccctggatgcggagcttgcagtgagccgagatcacgccactgcactccagcctgggcgacagagcaagactccgtctcaaaaaaaaaaaaaaaaaaaagatatgaagctaaacttcataaaaacagatgtaaaaatggccaataagcacacaaatgattatcacattagctaacaagaactagcaaattaaactcacaacgagaccactacaaagtcactagaatgggcaaaaatttcaaagactgactatcaaatgttggtgatgatatggaacaacaggaactctgatacagctgcttggaaaaactgtttgacagtgtcttacagagttaaatatacaataccctatgatcaagaaatgccacccctaggtatttaagcaagagaaatgaaaacatgtctacacaaagatttatatagcttcattcatagtagccagatattggaaacaatcacatatccaataacaggtgaaaggttaaacatggatctccattcagtgggataccattcagtaataacaataaaaagaaattcatcataattttattctagctatgatggagtaattggcaatggataaaccgtcctgccttaaacaattaaaaagctggctgaaatatgtgcatccaaaggtttttcagacattgggcagcaggtagcacaagactgagatccctgagcaaggaaggcaaacaagctgagctctataattgctcctgctcactgcctggagtctccatccaacagcacaaggagggagaatccaaacagagcctacaggtctcactgagcagaagagacggagtggaacttcagggaaatcaaggcagctagaatccataagaagaatacttggagaggaggaagttgcacagagagaaagttctggagatctgaagaagggtcttttgagactttggctgaatatttatctacctttgcatgtaagaaacctcctgaggctggagaatgaaccaccagtaggcagaacaatccttggacctcacaggggaatgagaatagctcctgcaagctgcaatggaaaaacctccaaacacattgggcatcagggtcaatcatcaaagaacaattgcctccatgataggccaaattagccctaggctaaagtttattccagatctgccctaacaaatctcaaaagcaagttctggaaggatctaattgattccaagtaactgaattgcattccagaacaaaacccaacaatatttaaagcagtatcataaaacccagaaacttcagaaaaccagaagatggagaaagaaaaaaaagaaaaaaaaaatccagcaatgtaaaatccgaagtgtccagatctaatcaaaaattatcaggcaggccaagcacagtggctcatgcctataatcccagccctttgggaggccaaggaaggtgaattgtctgagctcaggagtttgtgaccagcctgggcaacatggtgaaactctgtctttaccaaaaatgcaaaactttgccagggatgtggcaggtgcccaactactcaggaggctgaggtgggagggtcactgaagcctggaaagttgaggctgcaatgagccatgattatgccactgcactccagccagggtgacagagcgagaacctgtctcaaagaaattttttaataaataaataaaaattaccaggcatactaggaagcaggaaaatatggctgattatcaggagaaaaatccaatcaatagaacagatccagaaatgacacagaagatccaattaatggacaaggatgtttattataaatacactctggaagttcaagaaagtagggaaaactgcgagcatgttaaagggagagacatggtaggtgcgaaaaaaaccccaagaggaacttctagagataaaaatacaatatctgaaatggaaaatacacgggatagagttaacagcatattagacactgcagaagaaaaattagtgaacttgaagtcatagcaaaataaattatccaaagtaaaatgcagggggaaaaagactgaaaaaattaagagggctctggagcaatatgaaactatttgaaatatgtgtaactggagtcccaggaaaggagggggtggcacaaaaatatctgaataaatcattagcagggcacagtggctcacgcctgtaatcccacattttggaaggttgaggtgggcaaatcacttgaggccaagagttcaaaaccagcctggccaacatggtgaagccccatctctataaaaaaaaaaaaaaaaaaaaaaaaaaaaatagccaggtgtggtggctgtaatcccagctactcaggaggctgggcacaaaaatcacttgaacctgggaggcggaagttgtagtgagccaagattgcaccactgcactccagcctaggtgacagaatgagactgaaaaaaaaaagagagagagagaaagaaaaagaaagaaggaaagaaagagagaaagaaaaagaaagaaagaaagaaagaaagaaagaaagaaagaaagacagaaagaaaacatgacctcatgaccaaatttgtgtaaagtttgatagaactacagatccacagatccaagaagctcaaccaaccccaagcagaggaatcatgaataaagccacgccaaggcatataataatcaaattgctaaaaaaaaaaaaaaaaaaaaaaaaaagatttttaaaaaaaatccagcaaaaaggagttgcatctagactatattgaaaaactcttaaaactaaaaaataaataagcaatccaatcagaaaacgagcagaagatatgtgcagatatatcatcaaagtatatatacagatagcaaataaacacatgggaagatactcagcactgttagccattaggaaaatgaccactgaaaccacagtataattataggcctatcagatggctaaaataaaaaaaaaaaaaccataatgaagccaggcgcagtgaatcatgcctgtaatcccagcactttggaaggccgaggtgggtgaatcacctgagatcaggagtttgagaccagcctggccaacatggtgaaaccccatctctactaaaaatacaaatattagccgggcatggtggctcatgcctgtagtcccagctactcaggaggctgaggcaggagaattgcttgaaccgaggaggcggaggttgcagtgactgggaggcagaggttgcagtgagccaagattgcaccactgcactccagcctgggcaacagagtgagacttcaactcaaaaataaataaataaatgtaaccataatgccattaactagaaagaatgaggagaaactggatcactcacacattgctgatgagaatataaggtggtacagctattctggaaaatagttttgttgtttcttataaaattaaatgtgtacttaacgtacagcccaacaattacactcttgggcatttatcccagaaaaatgaaaatttatgttcacataaaaacctgtacacaggctgggcatggtggctcacgcctataatcccagcactttgggaggctgaggcgggtggatcacgaggtcaggagatcaagaccatcctggctaacatggtgaaaccccatctctactaaaaatacaaaaaattagctaggcgtggtggtgggcgcctgtagtcccagctacttgggaggctgaggcaggagaatggcatgaacccaggagacagagcttgcagtgatgcagtgagccaagatcacgccactgcattccagcctgggtgacagtgtgagactccaactcaaaaaacaaacaaacaaacaaacaaaacctgtacacaaatgttcatagcatctttattcatagtagctgaaaaattgaaccaatctaaatgtcattccgtaggtgaatggttaaactcactgtgtgtggtatgtccacgccattgaatactactcagcaatgaaaaggaatgaactattgatacaggcaacaactttgatgcacctaaagggaattatgcagagggaagaaagccaatcactgaaagttatatactaatgattccaattataaagcattcttgaaataaaattatagaaatgcagactagattggtatttgccatggggagagggagataaggctgtcaagggatgcatgaaagaggcttgtgatcaccaggagagttctgggtcctgattagggtagctgatacattagtctacacatgtcacaaaattgaagaaaacgatataaaatatacacacaaaggagtgcatgtaaaactagtgaaatctgaataagccctgaatttgtaccatgatttcctgaattttatatggtactattgttacataacatgtaaccaatgggggaaactgggtgaagagtacacaggatatttcttttgcaacttcctatgaatctgtagttatttcaaattcttttttattttcttgagagacagagtctttctctgtcacccagcctgcagtgcagtggcatgatcatggctcactgcagccttgaactcctgtgttcaagtgatcctctggtctcagcctcctgagaagctgagactacaggcatgcactaccatgcccagctaattcttttagttcttgtagaaatgggttcttgctatgtttcccaggctgatctcaaactcctggcctcaagcaatcctcccatctcggcctcccaaagtgctaggaatacaggcatgggccaccatccctggccacacaattgttttttaatttagttatagtagtctgtaccactgtaggatgacaatagttaacaataatatatagtttcaaatagctagaaggaagatactgaacagaaagaaatgagaaatgtttgagatggtagacatgctaattaccctgactgatcaccatacattatacacatcaaaacatctttatgtaccccataaatatgtacaattattatatgtcaatttttttttttttttttgagatggagtctcactctgtcacccaggctggagtgtagtggcgcaatctcggctcactgcaacctccgcctcccaggtgcaagcgattctcctgcctcagcctcctgagtagctgggataacaggcatgcgccaccacacccagctaatttttgtatttttagtagagatggggtttcgccatgttggtcaggctggtctggaactcctgacctctggtgatcagcccacttcagcctcccaaagtgctgggattgctggcgtgagccaccgtgcccggcgtatatgtcaattttttaaataaataaaataataaatttttaagcacccaaagggaaaaaacccatattatatgcataggaaaaggaatacactactgatataggcaacaacacagatgaacctcagaaacattatgcttatgctgagcaaaagaagccagtcaaaaaagaccacataacatatgattccatttctgtgaaactctaagttatctagaatatctagattctaggttatctaggttacctagaataatcttcagtgacaggaaacaaattaggattggtctggggcattattagggtacaatgggaaaagtttattgcaacagggcacaagggaacttcttggagtgatggaaaaattttttttgtagatatagggtctcactatagtgcccaagctggtctcaaactcctggtttcaagcaatcctcccttcgagcttcccaaagtactgggattacaggtggatgccattgcacccagcccccattttttgtatcttgattgtggtggttgtcacacagatacatacatttatcagatctcactgaactgtacacttagtgtgcattgtattgcctgtaaatttatacctcacaaaagtcagtatcaaacagaaatggaaaagcatggactgtggagccagtcacctgttctgaatcacgtctccgccacttactagctgtgcaatgttggacatatttctttctttttttttttcttttttcttttttcttttttttttttttgatatggagtcttactctcttgcccaggctggagtgcagtggtgcaatgtaggctcactgcaacctctgcttcccaggttcaagcgattcttctgcctcagcctcctgagtagctaggattacaggtacccaccaccacaccaggctaagttttgtatttttagtagagacaggctcccaccatgttggccaggctgatctcgaactcctgacctcaagtgatccacccactttggcctcccaaagtgctgagattacaggtgtgagccactgagcccggccttggacgagtttcttaatctctctgcactccaattttctcgtctgtaaaatgagattaatgatggtaccagcatcactgtgtcgtatgagggtaaaatgagttgttaatagtgaatcacttcaaacagggcttgacacaaagtcagctctgtatacaagtttattaaataagcaaagaaaccagattgctgttttcaaacagatgctgttttgaaaaacaccatctcaataaactcatgtcaccctccgcctctccccattaccctcaagataaagcccaaagcttttccagtggctgtatcaccctcctctttgcccctcattccccaaggttcctgcccgggccatctgtctgtccctccaaggtgctatcctccccagattaagaccctctcacaggctgttcctcggcccagaggattcttccccttcctctttgcccggctaagatcaattcattgtaaatttcaagtcttcaatgaagccttccctgaattctctgaccaggccaaagcaattagccagaagaaaaggccaatacttctcttttatagcaccaagcacagctataatacatatttatgtttgtgtaattatttcatgctttcattcttcaaatatttgttgagtagtgctgtgagccaggcattattctatgctctgagaatacagcagtttacaaaactaactccctgctggtgtgttggaatgaaccaggcagaaaatagataatcaaataactatattatgtcagggagtgatgagtgccatggagaaaaatacaacagggtaggaaaaaggagccaaagaaggagcaggtactattatagacagtttggtcagggaagacctgaggaggtgacatttaagcagagacctcaggaagtgaaggaatgaaccacgggaatatctggagaaagaaagttccagaaagaaaagaaaatgacagtgcaaaggctttgatattaggagcataatttgcatgttcttcagtaaattgcacgaagaggatataacagtaggacatggggttggagaggtatcagggccagagtgagtagggtctttcaggccattgtgagcgctctgacttttacttggagggaggtgggagccactgaagggatattagccaggatggatgctctgacttgtttttgtttttgttttgttttgtttgagatggtgtctcactctgtcgcccaggctagagtgcagtggcacaatctcagctcactgcaacctctgcctccccggctcaagtgattctcctgcctcagcctctcaagtagctgggattataggtgcccaccaccacacccagctaatttttatatttttggtagagacgagatttcaccctgttggccaggctggtctcgaactcctaagctcaagtgatccacccacctcagcctcccaaagctctgggatgacaggtgtgagccactgtgcctggccctgacttttattttaactggatcaagcacattgattgctgtgttgagaataccctggagtggaacaatggctgtagcaggcagaccaatctaggaaagagatgacaataacttggtcattgatagcagtgaaggtggtgagaagtggttggattttggaggtatttggaaggcggaaccaaaagatcgaatgtagggaataaaagaaatagacaggtcaaagacaacgccaaggatttggcctgagcatgtagagagggagatgggaaaaccataggagttccaagtttagggaaggatccctggagctcagttttggacatactaagcttgagaagccttttagagtgcagatagcatagcaagtaggcagtttgatgtttgagctgcaggttaggggagaggtgctgtcagaagcagctatctaaacagagatagtcagtggttttttgtgtttgcttttttgtttgttcttctgttttgggggtttttttggggtgggggacagagtctcactctgtcacgcacgctggagtgcagtggcacgatctcagctcactgcaacctctgcctcccaggttcaagtgattcttgtgtctcaacctcccgagtagctgggattacaggcttgtgccaccgcaccggctaatttttgtatttttagtagagacggggtttcaccatgttggccaggctggtctcaaactcatgacctcaagggatccacctgacacaggctcccaaagtgctgggattacaggcatgtaatcccactgcacccggccccagatagtcagcatgtatttaaaccctgaatgatatcaccaagaaagtaaatttacggagaaattaggtgagttttaaggactgagacccatggcacccccattgccaagacgttgagtagactaggtgcagccagagaaatcaagactgtggaaaactccccaaaacaaacaacctagtttctttagccaatatattacagagagagagagaaagagaacctattaactcaaaaacaaaagattgatcacttgtagaatctagactttatttggatcctgattcaaacacgtcatgtctgggcacggtggctcacacctgtaatcccagcactttgggaggccgaggcgggcagatcacttgaggtcaggagtttgagaccagcctggccaacatggtgaaaacccatctctactaaagatacaaaaacttagctgggcatggtggcgcatgctaataatcccagctactcgggaggctgaggcaggagaatctcttgaacccgggaggcagaggttgcagtgacccgagatcatcccattgcactccaacctggatgacaagagtgaaactctgtctccaaaaaaaaaaaaaaaaagaaagaaacaaagcaaacaaacaaaaaataccataaaataaaataaaaaattaggccaggcacagtggctcacacctaatcccagtgttttgggaggccaaggcggaggattgtttgaggccaggagtttgagaccagcctgggcaacacagcatgactccatctctataaaaacatttaaaatttagcctggcgtggtgatgcacacctgtagtcctagccactcaggaggctgagatgggaggatctcttgagctccagaattcaaggctgcagtgagctatgatcatgccacagcactccagcctgagtgacagaacaagatcctgtctcaaaaaaacccaaaaaattgtgagacaattgaggaaatttgaacccctgattagatatttgaagattttaaagaattattgttaatagttttaagtttgataatgaaactgtggttatatttttaaaggagtccttattgtttcaaggaggggttagtaaagtaccacccacggaccaaatggaaatggccacctgattttgcgtggctcatgagcttaaaatgattttttaggttgtttaaatagttttttaaaaccaaaagaataatatttattgacatatgaaaatttcctgtgtgaaatttaaatttaagtgtctataaataaagttttattggcacatgtccatgcccattcattggcctattgtccatggcagcttcctgctaccatagcagagttgagtacttgggacagggaccacacggcctccaaagctcaaaatatgtattccatgttcccttactgaaaaagcttgccagcccttcttttattttatgtatttatttaattgtttttttttttttaagacagagtctctctctgttacccacgctggggttaccatgcctcagcctcccaagtagctgggactacaggcgcccgccactacgcccggctaattttttgtatttttagtagagacagggtttcgccgtgttggccaggatggtctcgatctcctgatcttgtgatctgcccgcctcggcctcccaaagtgctgggattacaggcgtgagccaccgcgcccagccgccatcccagcattctttaatacagatttccctcgtattgtctaacttgttatgcaaatggattatttttcccccaaggggacctccacaaccagctttgaaaacaattatgcttactttactgcccaggacaaaaacagtaaaacttttgaagttcccagacaccaaaagccctgcattctaacaggttttgagcaaacctgatcccaaagcactttgtaggtgtgttggcccaccatcaccatcctgtaactggaatgctcaactccaattagaagtcttcctggtttgggtcatttggggctttggggaacctttgacccttttttctcccttccctttgggcagctgccctgggacattggccccattcacaattctccagtttcccagacaatgtggcttcttgtgctctttgctcgggcccctctattaaccctacagagaggtttcaggttactgaaacagacgccttgctttctgctgtgcataatgtcctttttccagcgagaaactgcagcccatcaggatctggttttcattaaaggcactttgggtcacttttttagcagattggtcaaaaggactgaaaggactgggcagggcgatgatgatttggaggtcaatagctttctctatgggccataccccttccccactgaaagattcccccactgcagactggaggaaatcagtcaggcaaggatccctgtggtgaaaactactcgaaaacagcaacaataaccacaaacctgaaatgaagacaatttcctgagaaactatgaatgtttggatgtgcaaggtgatcaactttcccagttgcccgggaccaaaaggtttcccaggactcaaaactttccattttgaaaccagaaagtcacaggcaaacccggaggagttggtcaacccatggatcagagtcacttcatcttctgtgaaatttgcaaagatgctaggaggttcccctcctgctgggacaccccagcccagacacaaaccattaattcacaattacatggagtttcactgtctgcaaggctgctccatttaagctctgggtcatgaacacataactctaggcatactgacactagctgggagattttccaccaaaaaaaaaaaaaaaaaatgccatttcatgactattaatccaaaataggtaaatgtgtctggcttatagaataccagcctgattacaaatgcttggtgttggaatggcccagctcacagtggttgtagaagtccagtaggcccaggctttgtggctcactcctgtaaccccagcactttgggaggccaaggtgggaggatcacttgagtccagaagttcaaaaccagcctgggcaacatagggagactccatttctacaaataatttaaaaattagctgggtgcatgcttgtagccctagctactcaggaggttgaggcaggagaattgcctgagcctgggaggtcgaggccacagtgagccgcgatcacatgtcactacattccagcctgggtgacagagcaaaaccctggctggaaaaaaaaaaaattcaagcagtcaaggggatgggagcttggtggactagagatgcccagacttgagttcctgtcccagccctgccactaatagtgagattttaggcacagctattccccttcttctctcctaagtctccggagaacaaatggctttggattcaatgaggaaaagaaggaaagaaaggaagaaactggtctcactgagcatcctctatgagccgggcatcacaccaaaccctcctccctgccatttactctttccaccagccttgaagggttaccgtactcagtttcacagatgagttcagtgcacatgaacgatcacacagcaagcgaatggcagggagggggttatgatgcagggctgtggggctccctagtaaccttaatcccagcagtcatttaatgagacagaactaagtacacgcctctctaacatacattgtctcgcttaattcttgtagaatctttgaggcaagcattaccattatctctacttcacagatgagcaaatgggttctgagaggtcaagtgacctgcccaaggtcacacagctatgcatgcacagccaggtggcaaacccagagctaaatgattccaacgctcactggctttgctctccagtgtcagctcagcagccctgaacctaaaactccaggtggcaggtgccaccccagggataagaccccagctttaacctgaaccaaaccttaaccagctgtgtgctattgggcaaattccttaacctctataggcttgcatttcctcctctgcatagtaggcatggcactcatacctccctggcaaaaaactatcaactttatttgtttatttatttatttatttatttatttatttatttattcattcatgagacagagtctccctgtgtcgcccagaatggagggcagtggcctgatctcggctcactgcaacctccacctgccggattgatgcgattctcctgcctcagcctccggagtagctgagattacaggcgcccgccaccacacctggctaatatttgtatttttagtagagatggaatttcaccactttggccaggctggtctcgaactcctggcctcaagtgattctcctgcctcagcctcccaaagtgctgggattacaggtgtgagccccggcctttacctgcatttttccatttcttccacacaactgttatgaggtaggcattactttatacataaaatacataaagaactaagcccagcactggcacatataagaatgcaatgaatcgtagctattattactaatgctattgtttttactgctgctatattattataacaaataatcattgtgatagttattgcaacagttgtcatcgctgttattatattactaagtagttttggatcccttttctcgaagtttcatcgtcccccccctccaagtgccctccaatcccaggagcccttaaagccgctgcacccacactttgcccaccctctttctctcggtctgtcccccacgccatccatcacctgcaccccttccctagggaggcccagcggtgggcgcccacccgctcccccagcgctttgccccgtgagtcctccgcccaggcccccgcgcgcgcctcacctgcggagcccggcttggccgcactgagtcccacgggcgggcgggtggcgcagggcggggccgcggggctcatgcggggagcgggcaggcaggagagcggcggggcggcgccagccggcagctctgcgacctcctccctgcagcggcccaggtgggaactcagccagggcagcggcgggggtcacagtccccgcctgggacttcctatctgtcgaagctt

SEQ ID NO: 469 - DNA, 1860 bp, Homo sapiens
ttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaacttattaagtccatctgagaaactagagccttgggacccagggatgaggaaacttaccgtacagacatgcgggctgaccttcattcaccctgcgggccatggcctctgccatccaactgcacaggcttcagccgaaactctctccagcactgccctaaacagaccaagtgtgagggagggagcatgtaatgaaaagtccacagagaacaagaagccacaagattcggtgctctggagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcggcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccgcccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgagtcataaaacatcatttgcctttcaatttataccttccaagtgaatatgattattgaggattatctaattattatctacttttctctctagatataaaaaacaccatagatcctatacacacaaaaatggtttttctatcagaaatggactcactcgcctggcaaaaggacacagattagattattctaatctcaaggccccttaggcttatgaattcaaaaaaaaaaatagaagaaatgaacaaaaacataaatcacagtttgttattaagtaatatctgaaatgaattagaaagaaaccataagccttaacaatactccaatcacagttaaattaatttagacagaaaagcaaatagcaattgacttgaaaataagaagtggagccgaaggtggatacaagaaatccaggagggctaagatatatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgcaaaaaaaaaaaaaaaaa

SEQ ID NO: 470 - DNA, 2274 bp, Homo sapiens
ctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 471 - DNA, 708 bp, Homo sapiens
tgtggaaagattgatcactggacacattcagaaacagtatcaatgacagactttgatatacaatatacttaccttgggggtcatgtatgtttgtctgcacatgcaagaaatggttcaaaacaatgggggacctatgcagaagctataagtgcatgtggtcaacacaggttatgtagattccaaggatgcaaatatcttagtgacataaatataacaagatataacataaattgcagagagaatagggcttgcaatgaacttttccattgtcagtgtgatcctggttatgcacctccagattgtgagccgccaatatcatcaccaggaggagtgtttaatgatggatttaggcttacggtagaaaaaagtgtacccttgtttccaaaacgacgtgctgctcctaaaaacaatggtcttttgatcagtttctacatttctttttcacctttgctcattttaattgctattgttagtcttaaatggaataaaatgaagagattttggagcaaaggcggaacaataagcagcatatctatctcagaagacagcagcaggaacaacaacgagtcacagagttaaagtagcccaagtgataacttcgaagccatagggtggagaaaggatattaccaagaaactcaccattaactggcctgatctaacaatgaaaaaaaaaagttttctctcattttgttatggcttaaagctt

SEQ ID NO: 472 - DNA, 148489 bp, Homo sapiens
gatccgtctgccttggcctcccaaagtgctgggattacaggcgtaagccaccatgcctggcctatatccaatgacttctgagtctctattgcatcttctccacactagtcactggaagagggggtggtaaagtcccacccaaacatgtctccttttcccccgatttgatgctgcaggtgaaaccatgccctctggtacacaggagcaagtcttccagctctcctcgccctagaaagtctagcacagggggtgcacctgttctcttatcagctgcttaattaaggggttccattgtatttcccagtcaattttcccactcagttccccaggagaagttatttttaagtgttactggaattacagtactaaccaagtctttcttctcggatcagtgattaagacttaacctgctctgggtgtgtcacttaacacttcaaggtcgtaggtgggcatagctcatctcagggaagctgaggtgcctgggactgagtaggactggatgccataatgctccccgttttactggagagaaaaacttcttggaagagccccagttgggaagcatttggcaagttgatttattgatccaattgcgttttccagctggataggcttcaataactgggaaaagctagtaatgagcccacagcatttggcaccattcaggactcattgtggagctctaggaatcctgggatggggatctagacacgttgattaagggcctgctatgagtaagttactgggagaccaagttgacgagatgatggctcaggagacacgaagtgcttagtgtctaatacccaacgagcaagggttggagctgaaagcaaacagaatctggaaatgccagcctgacccccagtactctgcccctgacatgcctgcctgtcagggcagtgccagaaaagcctctcaggaggttgggtcagggcaaggcaggagggacaagccaagaggctgggagctaaggcagtgggctggagggtagagaggcacggagagggggaagcccatggaggccaagcgtaagtggggtgggatgctatattagttaggatacaggctcagctacatggcacagagacccagagtaactgtggttttaaaaagatagacgtgggccaggtgcggtggctcatgtctgtaatcccagtactttgggaggccaaggcgggtggatcacaagttcaggagttcgagactagcctgaccaatatggtgaaactccatctctacttaaaatacaaaaattagccgggcgtggtggcaggcacctgtagtcccagctacttgggaggctgaggcaggagaatcacttgaacccgggaggcagaggttgcagtgagctgagatcgtgccattgcactccagcctgggcaacagagcaagactccatctcaaaaaaaaaaaaaaaaagacatgtatttattaagtgaagtctgataaaatgaccctgctcagtgaagtcattggaggctcaagcttcttttctcttcttgttctggcatgtctagattgtcgccctcatgtgcattgttcagcataactcaccaccacatccgcattccacccgtggacaggcagaagggaaccaggttggacaggccccttccccatgcgggcacctcacatcctgttggccagaacttggtcacatggccacacctagctgggaagcctgggaatcctatttattttgggtgaccatgtgctctgctaaaatgtctactgctatggaaaaagggaagaatggatgttgggggacaccaagcagtaggccacagacatagactagctggaagcgggacaaaatagggtccacatgaggcaagtcccaataccaagtgtaacactcctctgtgaaccctgtcaggatggtggagcttgcaaatgatggctttgctcagacagaagagagaaacacagagaagagagagattacactcatcgaaagaactcaggaaggcatcatgtaggcatgcatttggggcttttgtttttgtttgagacagggtcttgctctgttgtcctggttggagtgcagtggtccaatcttggctcactgcagccttggcctcccaggctcctattatcctggattccattcctgccacaatcttgacacaactgacctgtcttcttggtgtgcccttcctctttagctgttgtcagaatcccgcctctacttcaggccctggttcaaatgcatttgcaggtgtttaaatgcggggagagatgaggatatacttcccctgctctctcatgggccaacacaacagtgctctgatgctgagataagcaaaggaaaagaacacagggtaagatgaagcttggggctctagactgagtttatgccttcccagaaagagctgaatctcacaggttttacataagcaggtgatgtttcccgctgtgctccaaacaggctacaatccttgccttctcctctcatttatttgtgggtgagatggctgtgccctctaagttcccacagacacatcctccctgtctccctgagcccagatgcttaacacggggctttaacccgatgctctcattccccgtaggcatctctgtggggatggggagagaggatgggagccaggctggcatcgttacgcatatgtaatagagccggaagagttgtgaaacccaggaggttctgctaagctgttccacagtcaatagttgcaataaaaataaactgattctgctattcgacaacaatgagcgataccccagggttgccagcgctggaagtactcatatgtctctgggcacgctgctgtgggtgcagtccagcccacgcagcatgtacacagacttacctcccgcatgttttcagctgatgaatctgtggcactgcagccaggtatagagaaatataaagtcccacatctgagtcaacaaaataaaacgaaacaataatcaccaacataagggaagcagagtttgagtgcagctggtgtaactaaaagattgaaaggtttttgtggacttcacatttaatatgagtcaatggtatagagttagtatgaacttgctgatgtagttcttaactgtattcaaaccagtagtgttttactggccagaacgctactgatgctactggcttgaatacaggtaaggactacattagcaagttcaaacgttactatgatctgaaacagaatcctgcttcggatcatagtaacatataaagaacatgcagataggctgggtgtggtggctcacgcctgtaatcccagcactttgggaggctgaggcaagtggatcacttgaggtcaagagttcaagaccagcctggccaacatagtgaaacaccatctgtactaaagatagaaaaatacaggcatcatggtgggcgcctgtaatcccagcttctcgggagaatgaggcaggagaattgcttgaacccgggaggcagaggctgcagtgagacaagatcatgccactgcattccagcctgggcgaatgagtgagactctgtctgaaaaaaaaaaagtgcatgcatgcagataaaaagactcaaggatgctacaagaactcaaaattatggaggtaaattcagagaactgaaaccctgcagcctggaggagacccagaaggccataacgatcacctttacatacccgaagggttgtcatggggataagagaccaatgcattcacgtgggcccaagaaggaagttacagcctggccaattttgtctcaaaatggaattgtcttaaaaagtaatgctgtttctcatgagacagtgaattctcccttactagaatttgaaaaggaggctgggtgaatctgtgggtgagacgcagtcacagaaattcacatgttggagaatgacagggctaagtgacctcttgagttgctttcaactttgaggctttatgagtccatgcatctttttctaatgaaactttctgaaataattgtagatgaatccgcagtagtactaaataacccagagggatcctttgtattctttacccagtttccctgcatggtaaaacttagagactaatacagactcatagccaggatactgaccacttcctcatggtctcattcttcttctgcctcaatagtctctgcccttgaggagctaccagtctaaaggaggaaaaacacaggcacaataaaaaatcgtgctagttgagcgtcagccagctgagtgggaccaaccaaatgctactgatgaccagaagacagagagatcatgtctgcccggaaatacgaggagaggctttccaggggaagtaggtggactctgaaggacaaataggaactctaccgacagtgataagcgtacttagttaaggacctgtggttgtccggctcattattcattaagagctagaaaaaagatacgtttccttgtgaatggctttctcttgttacagattttttttttttttttgagtcagggtttcactctgtcacccaggctggagtgcaatggtgcaatcacagctccctacagcctcgaccccaacccgaccccacattcaggtgatgctgccacctcggcctcctgagtagctggggctacaggcacgtgccaccacacttggctaattttaaaaaagctttttttttttacagatgggatttcgtcatgttgcccaggctggtcttaaactcctgggctaaagcgattctcctgcctcagcctcctcaagtgctgggattacaggtgtgagccactgcgcccagcctcttattacagatctaatacataacccgaaagtgtcaaagaagcgaagctcagagaaccattggcagcctctgggccatgcttcatccagttcctacgcatccctagggcctgtgtatagtaggtgtttagcatctgctgagtgaatgcatgagcagagaaatgaatgaacaggttactgcccctgttgtcccagttctgctctcccaccccaaaagaagaagagcgtacaataacacggaaagcaatggcattgcttttgattgcctaaaaccctggtgggtttctagtgtttctgcagagcatgtgacgctgattaaggctgagctcacaggtgccccaaacatccccgacccaggccagttaattttgctgtcctctgtggctacaggttctacactctatccaaggtgtaactgttcaaagaaatctcagaatccacagttgctgaccttttcctgaaatgtgttgctaatcgagcccgcagagcaagtttctgtgcctagttacctttgccattgcctaacctccctcacctctgggtttgcggtgtgagaaaggaatgtgtttcctagaagcaaagaatggcagagcctaggggtttggggagggaggacttcaaaatatggaaaccatctggttccactcccttcttttacagactagaaaatgaaggccaggaaggggcatgtcctgcccagtgtcatctcgggagccactgggaacagagtccagagctccagcctcctggcctgtcttttgatgctcactctgaggcattcagctgtttcctccttcaagaaaagccagcccctcccgaacctcttactgacagctgtgtgccaagagtttctaattcttatgacaacacagcataggaattgggcgtgtttggttttcttatgtacagaagcataaaaaagatcaaagcacttacagtttgatgatgttcctaaatgcaagttcaaattgctgagttaaacagccagcaattcttttagagcctttccggagcaattactcaagatggaattaaactgtatttgcctttgattccttctcatccctccctctgcctgaaagggggagaagcaggacccaacaaagaaaatcttgagagacagttgttaattgcagatttttacctgcctgatgttctttggctttgcacattaattaaatcaagaccaggtgtcttgcagatgggttagctgctggctatggtatgagattaatagatcccagcaaatgggtaagggaaaaagctcttgagttttatgggtcattgatgctgcttctctcagcagaaattaccgcagagagagaaagaactccttgagcttaagtggcctagttcattagagagcttccacagctgctcacatgttaatcacctccagagcccagagaacaggcagatcccctctacagtagacctgaataagccatcagatctgaaggaagtcagacctcaaatgattgattattctaaaggaaattgcttcaggatttgaaggtttgtgacctgggccagaggctgccgacaggaccctaagcagcagctgggagtcagtggcgtgaccagatgctagtcccctgtctaccaacccttcctctgcgataactttcctaccactgccaaagctgagaaaggggtgatagaaacagaaccaggcttttcttgagacagagttttgctcttgttgcccaggctggagtgcaatggcgtgatctcacctcactgcaacctccacctcctaggttcaagcgattctcctacatcagcctcctgagtagctgggattacaggcatgcaccaccacgcccagctaattttttgtatttttagtagagaaggggtttctccatgttggtcaggctggtctcaaactcccgacctcaggtgatccacccacctcagcctcccaaagtgctgggattacaggcatgagccacgtgcccggccaaaaccaggctttagaaggtgctctggcagtttagaacacagttctgctcctacaggccagggccctcgctcttatcccaataagaaggactttgtattcgaacacggagtgatgcccccatcccagctctctcgtggcttagggtgtccaattccattggcaaggccaggtcaggtttctgtctgggggatccagggtcagtactgaggccaggatgaagcaagggtagggggacgctggggcagagggaaacaaaggtcacttcttatttacaaaggacacatttgttctagcgtgtcaagccctgggcttatgcacagtactggaccattcactggagccctgagctcacactaacaaactgagcggttccaaatgcttctcaaaggtctgccttccatggtgacaattctgattcaccatggctgggatggatttctgggtgagacagatgatgagcaaccaggagccatgcaaggccccccgagtctcacccacatgctatttggaggcaggcacacacactttttctttgagactgcaacagaccgtgaacacacattggtttgtgtaacttgaattcctttctaaagaaccctggacctagtccaccctcccctacagtcagtaaaccaaaatgtcatggctttggagagctggtagaaatgacgaagctgcatctggcagctaatagtcatgtcatgtcgttctcatcccagaaaccagcaaagtggttaaggtagtaatttaatctgctcattttttggttttctgccaactcttttcccaaaccgattccccagctggtcccttggccccatgaaactttcatctgtgctcttcagatggcttccaaagtagagggactcatagctggggttacttctaaaaactgggcccaggggccaggcacggtggctcctttaacactagtgctttgggaggccaaggcgggcagatggcttgagcccaggagtttgagaccagcctgggcaacatggtgaaaccccatctctacaaaaaataaaaaattagcagggcacagtggtgccagctactcagaggctgaggtgggtgggaggatcacttgagcctaggaggtcaaggttgcagggagctgtgatcatgccactgcacttcagcttgtgcgacagagtgagatcctgtcagaaagaaagaaaaaggaagggaaggatggatggggaaaggggaggggaagggaagcggggagagaagggggaggggggtgggaagggaagggaagggaagggaagggaagggaagggaagggaagggaagggaagggaagggaagggaagggaagggaaaggaaaagaagaaaaagaaaaattgggcccagggaagggacctacctggagaggagagtggagcagggccagggctggacgaggcagtgaggcatctaacctcaataggtaaggaggtgatctcaaggtcccatgaccacagcacttacatgaccttgacagtaagtgcatctgtcaattttgcatcctaggtgcctcacttgcctcaccctcatgtttgccctggtgtggaggatatttcttttttttttttttttttttttttgagatggagtctcgctctgtcacccaggctggagtgcagtggcacgatctcggctcactgcaagctccacctcctgggttcacgccattctcccacctcagtctccccagtagctggggctacaggcgcccatcaccatgcccagctaattttgcttttgtgtttttagtagagacagggtttcaccgtgttagccaggatggtctcaatttcctgactagtgatccacctgcctcggcctcccaaagtgctgggattacaggcgtgagccactacacccagccggtttggaggatatttctattcctgaaggaagtagttcacttcactggtgtgtaagccctgggtagctttctaaaaagataccagtgccaggccaattccatccaaacctttaggcatggagcctgggcatctgggactcatccacaggggagtcaactgtgcagctgggtttaccagcttctagcccaagggcttgctctgggccacaggtaatagatggatgttctgctgccgtctggccagggctcagttgtctctgacttgtctccttcaggattttctctgtgccccacaggtcccgaggtctggctgaacttccatacagacttactcaggccgtctgctcttggctacaataccaggcacaaacctctcccccaactcccaagataccagccgggctgtcagctaagttccatatcagcctctagagtatgcagagacttcccatggtatatgctgcattttctttgatgtggccacagatacccccaaataccttggcaaatagaccaaatatcctttgcaaataataccccaaatacccgagaacagagtgctcccctcaacttattgaacacatctcctcccagactggaacccaggaagacccgtgctcatctgaatgcccacctccccctttcccaccatccttggaaataaaagagctgcctccccctcccccttcctgccttgcagggatctcccatacacaaaactctgtgatctaatcctccaggcttctagaaaatcccctctccttagcacttggcttttgagcctattgtcatgtttgggattcacgaaaatttaattcgacagtgaaacctcagcaatggcagatttgagctccttccctgaagcattgaaaccccctgaatgggaagccccagagcaacaagatgtataggagagagaaaccctcctgaagaagagaaaccctcctgaaactctttcgaacatcatctccatgccacacattttgtgccaaagctcagcattgtacacagagccttggaacacacgtgctccattctgggtctctactcatcactctctcagcatttggagagcaaggtaaaagggaggcatttttattcccatctcttttttgtacaatgagacagaggagagaactaagtgacgaccaggggccgtcagagggcaggcggtggagtgaaggagacagaaagggagagaatgagggttcagaagtggacctggagtttctgtttatgtattcaacttattaggctcttgagcaggtcccatacattttattgggaaaattgaagtctttggcccagttatgaaaagctgaaaaatgcacaacccgtctctttctagaccggggtgcacagtctggactggcctcatgcatattgatttacctgactctcccccccacccgcccccacccacccccacccaggcttcatctctctgtcagtctctctgcaaacactccctttgcaggttggtgaggctcacttctccctctccagggaactcatcctgcgtctcactcctctctcttgccctgctccgctctcctaccctcctgtctgtggcccagcagggcttcgtgccagcccacaggccctacttctgtagctgtgcaaacactgctaagccctccaggctcccaggagctgggcctgccctccacaggagattaagagccacagtgagtcagtagcccagctgggcctctgtcagctggggcatccctcatctcctctcccctctggaccccttctccccattctgccagcccttaagacagcatctgcccccgtactgggccagcagagtcccagcgtggcccctccctgccccgaccccagctctggagcttcccgccaaatgccttggccttgatggttgcccgtgtctacaaggcagagaagcccgcagctatgtggtcacagtggcattctggaagactgagggaatggggtgtggatgcctcctctcggtggctgtgaccctctgggttcaaggagggagaactaaacagctgccaagactcatcgcaggccctgggtgcctacacactttgaatcacagctactgtaccgtgctgggtcactgccaggaatctgaggagacaataagctcttattttaaaaagatttgccagcatacccgggcttttacaaatgcttgataattattgccaaaaataggtattggcttagggtctccagtgctgtcctggcagctccagtgatgaggggcctgcaccatgtatgcagtccaaacctcgccacagagggggcctggaggtcagcaagccgggcacccctagaccccacagggtgggcattgtggaccacgcctttgctgctcgaggagaggaaggggaaccgcaggaggagctcttagtgccaactttgaagaacagagattgtgtccttgtgccaactactctgagtcacttaatgccattcccattcacgagaagagaaaaatctggtacacaggactaaccagtttgaatttccaacttcttggcaatccaagaatttcaggcttctataaatagcaaatcctccagtgctccctcctctgatgggggctgccctcttccaaccttgtattcattcagtgagcatttagcgagctacagaccagagagccaccctgcaccttacagattatctcatgcaacccctcacttaactgacgagcagggatgggacttgtccaggtcacagaactaaataccaggtgcccagccctggggtgaaccctatagagaggaaggtggaagagacacaacctcttctctcagagccccagattaccgggggaagcagtcacttgctcagagagcaacgatacaagggaaaatgtaattctatccataaaaagttgaaatggccaggcgcggtggctcacacctgtaatcccaggcctttgggaggccaaggcgggtggatcacttgaggtcaggagtttgagaccagcttggccaacatggagaaaccccatctctctaaaaatccaaaaattagcctggcgtggtggcgggtgcctgtaatcccagctactcaggaggttgaggcaggaggatcacttgaaatcacagtgagccgagatcatgccactgcactccagcctgggcgacagagcaggactctgtctcaaaaaaaaaaaaaagttgaaatgaagaatcgtgggagagcaaagacaccaggtcattcctgcacaaggaatctggaaggatatcatggggaacagtattagagttgaccctccagagaaacactcaggagtggatttagacactcagggagagaagaaaggcgaaagggatatgcagataaaagaaacagcttaagacagcagagatgggatgtctaaggaatgcaggccagtttggctgttatataggatgttgaaactaaatgatgggggtaggaaggggagtcggttacggggctggatgatggaaggtatggaatgacagggtgaggaatttgagcttcaccatcatcattatcatttaaaagcaccaatggcaagttgtcaggcatgttactgagcacgattactcatgtattgcagagtctgcactttataggaacttgaaatttaggacagaataaaattatggacagatattgaagctctatattatacataaatgaaagctatttaacacgtaagtatttcagtagaagtaaaggggcaagtgcatttaatggactagtgagggaagaaggcatctgggaatttgttcctggaagggatccctctatcctcagcctcccctgtgttcggcagctctgggaaaggcccagaaaagcagagatagcagtcttaatattagacactgacttagtgtggctttgtgccttctagatggctgatttctgagaaggaacaattcctggagcctcccgttcattcttattcattgctccagctctcctttaagtccagtcctgagattgtagcacatggaggaacacagattggaggggacagtgggatggtggacagggcccactgagtaccgttgtgcaggttatctactgcacgagaagtggcaagtaagaattgaaatccagacctcctcctctcattgagtcaaaatgagctgtgtccatatggcggtgagaagggtgctttttctagtccatgcaaaggcattttgtgggcttgtggtcctgacagagatgcaactaaacagcttctctagacagtgctttccagccttaccctcccactacttcccactacggcacatgggaaacacttccagcctgatgccctgggccaggtgccagcatggagatgactctcagccacccagccctctaccctcatccctagcttgtttgtgctccattaggctggagatctgagaaagggcagagggaaatgtttgctaaactagatcaaagactaagaagaattcacacacatactctaagcacctattgagtctggccctgccatcaaactgtcgaacagacctctgacgatcctgtgagactgtgtcaaacacggcactcaaaactctaacgtgtctgggcaaagtggctcctgcctgtaatcccaacacattgaaaggctgaggcaggaggatcgcttgagccccagagttctagatcaacctgggcaagacagtgggaccccgtctctacaaaagataaaaaagaaaaattaacctggcatgggagcctgtgcctatagtaccagctacctggcaggctgaggtgggaggagtacttgagcctgggaggtcaaggctgcagtgagccttgatctcgtgactacactccaggctagatgacagagcaagaccgtgtctgaaacaaacaaacaaaaacccacttcaatgcaatgtaagagtgggaatcccctcagagcccatgatcagcagccccctgactcccccaccacacgccatccctgacgggagctacccagcttctgtctgagcactttaaaggaatgacagagctgacgggccccgagagcctcttcattgtgagggagctgtggttgttctagcaatctcctctttttgtttagctgcaattagacccctgtaacttccactattgattcggcttctgccccctgttgccctacagatttgtaggtaagaaaagaagaaacagaaaaaatagcccctccacaataagctattcctttcttgcctcactcatttgtctgcaccaggaagtcaaaccccataagaaacgcccttaatactcccagctaagcatttcctattgcccatgttattacattctttgccattctttgccttcttcctgttcccagcttctgactcctgggctggttttctgaccacaggtcggcgagagtcacttggatttgattcccctcgagcgttggctcctgacttccctcctcatagcctcccaccactttgattctgctcttccaggcagctcagggtcaattctctgcatgcgtcagcagcagggtctttaggaacagttgcacaggttgcgcattttccttctgcctttcagccccgagaccataccttttccctcaggttcctgctgtggcagtcagtgttcctgctgagttcactgggttccttttgacggggcaagatagaggcagaagaaaatgaggcctgcttctctggggagccctggtctcccaacaacacacctacctttcccaactgtatcatttgctctgagagggcaggatacacctcttattaatctctgggtcctttatgactgagtccaacccagggccctaggcaaggtaaaggctcaggaagtgttacttgagtgaatgcatgaataaatgttaggagagtagggtttgatttctaggggtgagaggagagctgctgagcagcaggaaaagacgagaagacccctagggagtctcactctccctggcaactgctcagatgacttgctctcagaaaagacctcctggtcgtgaagtcactctcctgtgtctggcttcctcgcagatgcccgatttccttctctacaagaccaatctttcccagactggtccttggaaaaacaaaacaaaacaaaacaaaaaacaaacaaacaaacaaaaacaggcctttccaagctccattccttcttttccactaaatctttaacaaagcaagacacccataaggcctctcctgcaacagtgacgatgaggccctctaatgcagtagagtgctggcgggggagatggagaggagagaacaggaatgaaaagtagtctgaaggctaaatcaggagaacttgacctggagtgagtggtcagtagagacacaaggtggagaagggagagaggaggcaaagggaagtcctccaagagagggtggcggtcccatggatgaaaaacagaggtaggccaggtgtggttacaggttcacccctgtaatcccagcagtttgggaggccaaggtgggtggatcacttgaggtcaggagtccgagaccagcctggtcaacatggtgaaaccccgtctctaccaaaaatacaaaaattagccgggcgtagtggcgggcacctgtaatcccagctacttaggaggctgaggcaagagaatcacttgaacccgggaggtggaggttgcagtgagctgagatcgcgtcattgcactccagcctgggcaacaagagggaaactccatctcaaaaaacaacaacaaaaaataaaaataaaaataaagaaatacagatgttgaaaggatgtgctgactggagcagacagtttgagtttgattttgtgcatttttgaggtgtcatctagacaaacaggcaggattgtacaactggttattggaggtgtaagactcagtcttcgataagactattgtaatagaaacatagaaatctgagatgatggtgagcaagtgagggtgggaaagtttgccctaagactagtttctgtgtctttcagctgtttatgtcaggacaaaggcccagctgcccctgtcccagagctgtgaggaagcagaaagaaagagaacctagtatgttctaggaactgtgccaaatggtctacacaagccacatattcaattcttactagatatcgagaccagcactatccaatagaactttctgtgatgatgaaaatgttctctatatatgctaatactgcaactactagccccattttgctattgaacacttgaaatgtggctagtacaactaggaaactgaatatttcattttatttacatttaatgaatttaggtgtaaatgtaaatagccatgtacagctagtagctgtcatattggaagagcagatctatttcaacctcctcaattcttaggtgaggaaacaaagtgactttctcagcaaaattattttcattaaaatatgaactaatttgcaaagactccattttcatgtacctctttttgtataactgaggctctatgtgcttaatacgaactaacatggttaaaatttaaagcctgtataacaaaaaagatcttttgatgcatggagggtttccgtaaacttttaaatttgtttttaatgttagggccaattggattttttttttagtaatttagatattcattaatattaacacagatagaatagttaaccttgattgagtacttattatatgttaggtacttgtattagtcatctaatgctgtgtaacaagatacccccaaacttagcagctttaaaacaataaacatgttgcattagttcattttcatgctgctgataaagacatacctgagactgggcaatttaccaaagaaagaggtttaattggattcacagttccacgtggctagggaagcctcacaatcatggtggaaggcaaggaggagcaagtcacatcttatggggatggtggcaggcaaagagagagagcttgtgcagggaaactcccatttttttaaaaccatcagatcttgtgagactcattcactatcacgaacagtgcaggaaagacccacccccataattcactcacttcccactgggtttcccccacgacacacggaaattgtgggggttacaattcaagataagatttgggtggggacacagccaaactatatcattccaccctggcccctcccaaatctcatatcctcacatttcaaaaccaatcatgccttcccaacagtcccccaaagtcttaactcatttcagcattaactcaaaagtccacagtccaacatctcatctgagacaaggcaagtcccttccacctattagcctgtaaaattaaaaacaagttagttacttcctagataaaatgggggtataggcattgggtaaatacagccattccaaatgagagaaattggccgaaacaaaggggctacaggtcccatgcaagaccaaaatccagcaaggcagtcaaatcttaaagctccagaatgatctcatttgactctgtgtcttgcatctgggtcacattgatacaagagatgggttcccatggtcttgggcagctccgcctctgtggctctgcagggtacagcctacctcctggctgctttcacagactgttgttgagtgtctgtggcttttccaggcacacgttgcaagctgttggtggatctaccattttgggatctggaggatggtgcctcccttttcacagctccactaggtggtggcccagtagagactctgtgtgggacctctaacgccacattttccttctgcactaccctagcagaggttctccatgaggaccccacccctgcagcaaactcctacctgggcatccaggtgtttccatacctcctctgaaatccaggcagagagaggttcctaaacctcaattcttgacgtctgtgcacttacaggcccaacaccatgtggaagctgccaagatttgaggcttgcgccctctgaagccatggcccaagctgtactttggccccttttagtcagtctctaggctgcacacagcacagagaccctgggcctggcttatgaaaccattttttcctcctaggcctctgggcttgtgatgggagggctgccgtgaaaacctcttacatgccctggagacattttccccattgtcttggggattaatattcagctcctcattactttctgcagccagcttgaatttctcctcagaaaatgggtttttcttttctatcacattgtcaggctgcaaattttctgaacttttatgctctacttcccttataaaactgaatgcctttaacagcacccgagtcacatcttgaatgctttgctgcttagaaatttcttctgccacataccctaagtcatctctctcaagttcaagtttccacaaatctctagggccagggcaaaatgctgccagtcactttgctaaaacatagaagagtcatatttactccagttcccaacaagttcctcatctccttctgagaccacctcagcctagaccttattgttcgtatcactatcagcatttttgtcaaagccattcgacagtctctaggaagttccaaactttcccacattttcctctcttcttctgagccctctaaactgttccaacctctgcttgttaaccggttccaaagtcacttccacatttttgggtatcttttcagcagcaccccactcttggtatcaatttactgtattagtctgttttcacactgctgataaagacatatccaagactgggcaattaacaaaagaaagaggtttatttggactcacagttccacatggctggggaagcctcacaatcatggcagaaggcaaggaggagcaagtcatatcttatatggatggcagcaggcaaaaagagagcttgcgcagtgaaactcccatttttaaaaaaacatctgatctcatccccataattcaattacctcccacggagttcctcccacgacacatgggaattgtgggagttacaattcaagatgagatttgggtggggacacagccaaaccatatcacatgtattatgtcacatagtttctgaaggtcaggagtgacttagctaggcggttctggcttagggtctctgaggttgcagtcaaagtgtcatctgagaagctgcagtcttctgaagacttgatgggctggaggagccacttgtaaaatggctcacacatggctgttggcaggaggcctctgttccttactgcgtgaacctctccataggactgctcacaacacatgatccaagtgatccccacgaacacgtgatccaagaaagagagtgaccaaacaggaagcctcaatgctattttacgacctagccttggaagtgacatatcatcacagttgctggattctattggttacacagaccaatcctaatatcatacaggaggagatcccataagggtgtaaatacaggagacagagattgttgaggaccgtcttggagactggctatctcagtacttcacatacacaacctcacttcatcctcacaaaactagcaagtaaaggccctgcttctctagatgaggtgaagatggctcagagaagttaagtgaattcccaaggtctctcaggtaatgaacagcagagctgtgcctcccccaggtctctcatgcaaaggctgccaaatctacatgtttgcactaacaaccactctactacaccactccaacaggaatccttcttgatccattcccctgactcaacgcactttgcagcggctaaatctttttttttttttttttttttttgagatggagtctctctctgttgcccaggctggagtgcagaggcgcgatttctgctcactgcaagctccgcctcccaggttcacgccattctcctgcttcagcctcccaaatagctgggactacaggtgcccaccaccacacccggctaattttttgtatttttagtagagacgggtttcaccatgttagccaggatggtctcaatctcctgacctcatggtccgcccaccttggcctcccaaagtgctgggattacaggcgtgagcctgtaatttttttgagaccgcacccagcctgcagctgctaaatctttatcagaaaatgttcattcctgatttgttaaagaaaatttaaactaggaatagaaagatttttccttaccacaaccaaatgcaactcatgatagtgacaaatataatacttaattagaaaatattagacatggccgggcacagtggctcatgcctgtaatcccagcacttcgggagactgaggtggccagatcatgaggtcaagaaatcaagaacatcctggccaacatggtgaaaccccgtctctactaaaaatacaaaaaattagctgggcatggtggcgtgcgcctgtagtcccagctacttgggaggctgaggcaggaggatcgcttgaacccgggaggcagagtttgcagtgagctgagatcgcgccactgcactccagcctggtgacagagtgagactccgtctcaaaaaacaaaaacaaaaaagaaaagaaaagaaaatattagacatagggccataccaccctgaaggtgcccaatcttgtctgatctcagaagctgaaacattagacacagtcttgttaaaatcaggaataaaaatctctaccattactactattatttaatattgggaagatctgattcatgcaataaaatagaaataagaagtagaattattcaaaaggagaaaaaattatcattagaaattcccagataatcaactgaaaacacttgctgatattaatgaaattccatcaaagggccgtatctaagatacatggctcggagcagctgccttcctgtagatcagcaataaccagcaacaagacataacaaattgcccttctcccccatctcccctgtgccgcccgggagcctgtgctatggtcgtgctcattctgtggttgagcatttgcaccttgtcttagtccctttgagctgctctaacaaaatgcactaaacggagtagcttgtaaacagcagacatttatttctcacagtttcaaaggctgggaagtccgagatctaggtgcctgcagagtcagtgtctgacgagggcccacttccttctcactggaaactcacagggtcacaggggctcactagcactctggagtctcttctataagggactcatctcatccatgagggctcccctcatgacctcatgacctcacttctcaaaggtcccaccttctaataccatcaccttgctcattaggtttccccctgtgaattttggggagacatacagttcagatcacagcatgccttttcatggcttgtgtgtggagcaggtggcctgcaggtatgcagctgaagggctgggaggtgcgatagctacatgaggaaccctcatgctggaagtaagtgttccaggtaattctaggactgtccaaccccctgaggcataacacgcaatatcttgcctgccgctttgggttttccttttcagaggaaataaatgatggaagataggattctggcaggaactggtcagtgtctcacctataaaagccgaatcgagtagaaagtgcccctggttttttaatccagaagatctaggttggggtcctggctctggcactattcaccctgtgtccttgaagaggctacccacccacctctgtgttcttcactttctctccctgtgcggggaaagtcgggttgcccgtctcctaagagtcgtggggagaatggaatacgatgatgagggggaaagagctttgcaaacgaaagtacgatggaaacagaaagtgagactgttagaatcaaggagggctccacgccaacctgctgacaaagactcactcagtgccagctctctgaccggtccccacactctgcacttgatccagccgtcacgctacaccctggttccacacagggctcacacttgggtgaactgatccagccgtcacgctacaccctggttccacacagggctcacacttgggtgaactgatccagccgtcatgctacaccctggttccacacagggctcacacttgggtgaactgacaacagtgagctcctttggaccttgtggagtctttttttttttttttgagacagagtctccctcttgttgctcaggctggggtgcagtggtgcgatctcagctcactacaacctccacctcccgggttcaagtgactctcctgcctcagcctcctgagtagctgaaattacaggcacctgccaccacaactggctatattttttttgtatttttagtagagacagggtttcaccatgttggccaggcttgtctcaaactcttgacctcaggtgatccgcctgcctcagcctcccaaagtgctgggattccaggcatgaggcaacacctggccccatgttgactcttgtgggcagagaggacaggcacaggaatgcaattatcttgcaagattatccagacccagtttccttatccaaggatgagctttgatttctccaatggctttgtttgtattgtaatgtctactgtgaggtcccagggtcaaaagggcagcattttttagatatcacctcccttttcaacagagagatggtagtacatcctatctcagggcaaggcttgatgcctctcttgggctctaggtctggtcagcaagagagttggtgaccctcggtaggtcccaggggaaatgacaacgacaagctcctgcaatgtcttggggtacgagtgggcaaatgccgtgagtgatgcagagcaaggatggaggaagggtagccttagcagtcatcagaacatagagagaaacaggcaggcacttggagaacacggaacaggccagggagccaggaggagccaggagcaaggccgaggctccgggctcagggcccctcgcatcttaggagtttaaggttgactctcctgcttagagcccacacctctgcaggccttcagaagtaccacgctgaacaccagataggatttctcaggtgaacatttctccacctgactttcctgctgtgttgggaaacagagattctacgatggctgactccagttactaagccctctctgcctaaaaggagccattcccccagcagactagaaagtgcgtgtgtgtatgtgggcatgcgagtggtgaggacaggggtgttgcttaggaaatggggctggctgctccccatattcctgaaatgacagcagaggcctacatccacagccaaggctgtgtgggctgccgtggattgcagaccccaggcctcctgcaggctgagtatctgcgcttggatactcctccccctcaactgggtctgccctggccacaggacccacagggtccctatcgtggtcctgggagcggggagctacggggggagcctcttgagctccccagcttgcctgcgggcctggccctggattaaaaggctggccgccgtaaaccacagctgaagcccagctgtccctgtaagtctgcccggcccacttcccgaagcgtgtcgtctggagacgatcctcagctgtctgctgagagctaagaaactacttgagcgtgaagacttctggtgcaaacggtgcgtgtccccagctgagccactgctttgtcctgtctcccgccaagtccggcatttctctttagcctcatctcccccgaaactctttgctttttctctctctgaatgtgtctcgtctctccgtctatagctctgcctctgtgtgatttcgtctccatctctctgcatgcctgcctgtgtattcctctatgtttacttctctgtcctgtctgtgtgtgtctgtttctgtctcactgtgtgtttgtttctctctgtctctctttctctgctttcagtctctctctgtttctttctgtccctttaacactctgctctctctgtctctcgcttgctccctctgcccacacgtctgtctgtccccctgtctctctgtgtgtctctccttcagtcgtcgtctccttgtctctgtctccttgtctctcagactgcctcttagtttctctctgtaccgctgtctctttctgtctgtgtgcatgtctctttcagtctctgtctctttgattctctctgcctctcagactcagctctctgtctctcgttccttcattcttgaataaagtgcccaggggaaatgtccagcaagaacaagaccctccccggactccacagaacagagtagggtggactgctaggctgggtccatgtgccaggttggctcaacagttttgctgggaattcccctctggccacaagaagccatggccagggagggaaagtgtccagcagtggattctgggcctgcgaagccaggctccatctaagcttacttaagaagcaacagtaatagaccccccaccccccgccttagggagcagcagaaaggtgattacatgctgtgtcagctaatcccgtgaaaccctgtgtctccctccaaggagtcaaacattctcagtccttgtattcctccatccttccaagtggcaggaaagaccttcagaaaccagtgtctgaacaaaatgccagcaggaaaaccacaggtctctgctttatctaagtgagtgggaagaagggctgagggatggatcaagaattaatgaggatacagtaagtagaacaatgtacgactccataacctgagagcttttgaaaggacagctggagccagtgcttctggccgtacatacctgtgatcaagttacaccctctccccacaaaatagccacctagcaaccaatacaatatgaatcagagtcataatcacggccatttctcttgaatcaggggtcctgccagccactcttcatgtatctgcttagtccatcctaccaaaaactctaacagtcacctccccattttacagatgaagaaactgaggctcatagaggttaacttgcccgaagttacagttagtgagtagaagagctaagataagaacttaggactgccaggctcccagccagcctgctcgcctccctgtcagtcactgtcacctcactgtcactgtcactgtcactctgaagaaacattctgagtcaagtagagatgttcttttcacatttgagtgtccttttctgtaggtggatcagagtatagagacatctggacacaattaagcagcaggtcaagctgacctcccttccctgccttccaggcagcaggtggcttctgagcatgaccagcagcaatgctgttccaatcagtccaggtagcgcaggcccacggtcatgtctctggagcttcggcaaaatagttcacttgctgtgcctgcagctcaccagtggtcaaaagaaatccattaagagcttaagaaaaacatgtaagagaaaaattcatagttgagaaaattctattatgctgtgtttcttttgaattgggataaaaccgacattctacacatcatcatggcagagcacttttccaccagacttgacctcaaggcctaagaacagaggcaagagtccaccgaagactcctcgtccggggcaacagcaattaggaggcgtgcatgtgcctttcaggtctcaggtcagagaaaatttcggaaacaaggtaaaaagaaaaagggaagaaagacactcagttcattcctctgtgaatgccccactccttccttcagtggagaaagaggtctcatcctcaatcattgctcctgcagacacagcgggggcagggcagcatggaggaaagccaggcagtgcagcgtgctgccacactcacagatatggaaacctgccgaggctctctgagttaatctcccctggccatgacctcatgggaacaagatgtgtgtattttgtgccaggatgagactgtggcttcacacacaaaaaaagtttatgaggtttaaaataactcattgctctgattgtaccacagtgacccagagagcacacacccaaaaaggattttggcccaattgccaagttgatggtctttatagatgacataaacgggattccgttccattcttcaaatacttcccgagttcctactgtgtgccagtactgagctagacactgaggacacgaaaataaatccgccatgccctctgacctgagagagccgataactccaggcagggatatcaaatagaaactcaaatatctatcttcagcatatatatatacatatatattttgagacacagtctcactccaggcttcagtgcagtggcatgatcttggctcactgcaacgtccgtctcctgggttcaagctattctcctgcctcagcctcctgagtagctgggattacagacatgcaccaccacgcccagctaatttttgtatttttagtacagacggggtttcaccatgttgatcaggctggtctccaactcctgacctcgtgatctgcccgcctctgcctcccaaagtgctgggattaaaggcgtgagccaccacgcccggccccagcagatattttctgagggcctactacatgccagacattcagaactagcgattaccaaaatggtagtctaatggcaaattagactctctttgttgaccagctaaaccagattcaattcagtttcatggacaagtccctatcatttagcaacttttaaaatgctgtccttcctgctagactgtaagcttcatgggggctggggctacacacatgccttgttcacagtgtgtcttcagtgctgagatggtgtctgaagacggtgtctacagacggtgagtggtcaagaaatccatgaacctggggaagttcctaggctatggggggagcacaagatggagaagggatgaagaacaaagggttcactcacaaattatcctctctctctctctgtctctctctcatgcacacacacacacacacacacacacacacacacacagagtcaattaatgacatagagtgaactgtaggcctcaaactgccacggctcacagaaattgtcatggttcccaggctctgagccatcgcgtggcagataccttggttggctctctcaacacccacttcagccccttgcccttgccatcatgaccacagagtctagaaagctgaagtacttaacttcccagcctccctggcagctagggatggccatgtgacatagttctggccagtgagatgttggcgatgtctctgggcagggccctaaaactagggaccctaaaactaggatggttgcagtggtctggaatctttggagtcttccctgcttcaagaacccgaggactaggtttgagggggaaagaggtggcaccgagggagagcagaagctcacgtcctcgggataagtcttagctgctctctgacccacttctccttcctcatccaccctttcttattgtggcagcctcccacctcctctgccttccgtcttcatgccaaacacatttaaacaatttggggcggaatagtatttgttagtttcgggctctgattctccacgggagtgatcttcaaccaaacagaaaagataatggtaaaatacctcattcagatttacttcaaaataatatgaaatgggaagtgagtggggttaccgctgcagcaggattggctctgagttgataatcgctggagctgggtgatggcgttattcacaacagccaaaagctggaagccacgtaagtatccgtcgacagacgaacaggtaaacacaatgtggtgtgcacagtggaacactctttagccttagagaggagggaaattccaacacatgctgcagcatggacgaaactcgagggcgttgcgctaagtgaaatacgccagtcacaaaaggcaaatactgtatgattccactcacaggaagtagttacaatagtcaaattcctggagacagaatgtagaatggcggttgccaggggctggggagggaggaagggggatgtgttgtttaatggctgtagtttcaactttataagataaaaatagttctggagatggttgcagaacactgtgagtgcaattaacactactgaaccatatccctaaaatgggtaagatggtacattttatatctattttacctcaattaaaaattttaggccgggagcggtgactcacgactgtaatcccagcacttcaggaggacgaggcgggtggatcacttgagactaggggttcaggaccagcctggtcaacatggtgaaaccccatctcttctaaacatacaaaaattagccaggtgtgataggcacctgtaatcccagctacttgggaggctgaggcaggagaatcgctcgaacccgggaggcagaggctgcagtgagccaagaagatcacgccacggcactccagcccaggcgacacagtgagactctgtctcaaaaaacaaatgaaacagctctgaggtagtgattcagggactacctgactctagagatcggaaaacctgaatagagtgtgaagacacggggattctgggacagcagcagcttaatgtgtctgccttccctccacataacataccattccagacactacccaccacctcttccaagccaacttgttactgcggccagcaggtaggcaagagcctgaaggaaatatgctgggtggtgaagtggggcttcctcccctctaagagagcctggacgagattctaagggaagtaccgctctggccacatacacatacttgtctcctcagcccccaaaaagctaaggaggaactgaacaggtgagctgtgagacccaggggcagctcctcttgctcaatagggaatgcctactggtctgcctgctcttacctggacctccagggaccgacagcaccgaggcccctccacaacctgtggttttctagctgctgagccacaggggtcaggcaaagaaaggaaacaacataccaaggaggccgaaggcgcaaagggaggaatgcaccaaaattccagaacgggcttccggggagacagagcacagtgcaacaataacaacagcagaagaactcaacgaatatggcctgaaacttcaaaacattctttttttttgagacagagtcttactctgtttcccaggctggagtgcagtggctcgctctcggctcactgcagcctccgcctcctgagttcaagtgattctcctgcctcagcctcctgagtagctggtattacaggcgtgtgccaccacacctggctgattttgtatctttagtagagatgggttttcaccacgttggccaggctggtcttgaactcctgacctcaagtgatccacctgcctcggcctcccaaagtgctgggattacaggcgtgagccaccgtgcctggtcaaaacattcttatttaaccaaaaagtgaaatggataatttaagtggaaagatagccagagataaggcttgaattcgtggcttgacggatgaatgtgaggaatactgcaaaccacagagcaaaatgcagaggggtagaaactgtcggggaaaatgggagccatttgcagggcagatttaggagacctaacaggggaccaataactgaatcaaagaggacaacagggacaaaagacagcggcctgacagatacagactcacgggttataaagactgcagccttggaattgtgtacctagccaagccatcattcacccacaggagtgaaacacacacacacagacacacacgtatgcaaggattcaaaaattacatcgctcacatgcagtctctgaagaaaagagttttaaagacctcaaccaaaataagcccggcgcagtggctcacgccctataatcgcaggactttgggaggccaaggcgggtggatcatttaggtcatctcagaaaaaaaagaaaaaaaagacttcaaccaaaatccaatgaattctaacagagaagaaaagaggaaacagaagtgaatgataaatcacgcttaactatatatgtgtagatatacatacatatttaaccatatatacccacatatgtgtgtgtatatatatgtatttatgtatgtattgatatatacatatgtattattaaatataaatggataatgacagactgtctggaaatgtgtaacactgaataaggattcttgaaatagaagtgaaacactgcaaaggaaattctcaacctcctgagcagcagggattacaggcatgcgccaccacacctgcctgattttgtattttcagtagagacaggatttagaaagaaaagtgctaagcggtttcagctgcacctagacgctggcaacagggcgtggggagtaaaagcatcccacagactaattggggtgacaggaagaaaatggggaaagtaacggtattctgaatgtctcattggtggaggaaagaaacacctgaaggggaggaatagtcagagaatagtgtctgagtggagaaatcatatctcgtatccctataatactaaagaaatagagtttgattatgaacaccaggaaaggaaaggtgatataaccattcgcggaatgaaaatgtccacattaataagggtggaaagcaacctgagcaagccactaaaattaagaaaaaaaatcattagaaacataagctggaaggaataaaatgaaatacaacagttgtacactattgttgtacactatctctgtgtacacagagaatgaactgaattctctctttaaaaggcagaatatagactgggctaaaaaaccaaaaatctatctttttttttctgagacggagtctcgtgctgtcacccaggctggaacgcagtggtgtgatctccgctcactgcaacctccgcctcccgaggttcaagcgattctcctgcctcagcctcctaagtagctgggactacaagcacgtgccaccacgcccggctaatttttgaatttttagtagagacgacatttaaccatgttggccaggttggtcttgaactcttgacctcaggtgatccacccgccttggcctcccaaagtgctaggattacaggcatgagccaccacgcagcacagccacaaaaacctatcttaatcctgtttataagaaacagactttaaatggagtgataaaggaaagtttaaagtccaggaatagatccatgcagatgggaaattttactacatggtaagagtgccatttcacattattgggaaatagatgagtatttccacaaagaatgctgggacaatcagatattcatttggaaaaaagcaaatttggattaaaaggaaatcacctgggccggacacagtgtctcacgcctgtaatcccagcattttgggaggctgaggcaggtggatcacctgagatcagaagttctagactagcctggccaacatggtgaaaccctatctctactaaaaatacaaaagttagcctggcatggtgatgtacgcctgtaatcccagctactcaggaggctgagacaagagaatcacttgaacccaggacgtggaggttgcagtgagccaaggtggcgcctgcactccagcctgggtgacagagtgagactccagctctaaaaaaataaaaataaaaataaagaaatcacatgaagcaaaatagacacactcaagaaaattaaaagacaagcaacagattcagataaaatgtttcccacatatatttattaataatagacaaagaagtaatagctataatgtgtaaagatatcctaaaaatcaataagaaaaaggcaagctaccaaatatagcaatgggcaaataatatgtacatttcacagaagagaaaagccaaatggccaacaaacccataaaatgatgttcaacctcacttggaataaatgggaaaaagcacattaaggcaacgccttttttctctcattggatcgacgaaaatgttaaagatttataatatcaagtgatggcaagggtttgggggagtataaatacaatctctctggaagtcaatttgacatctaatgtaattgttttgcttaaatctaatacaaccttaaatgtgcctttcttttgactcagaagttctacttcctctctttattctagaagaaggcatgtgcaagaagcaatgtgcaggatgcttacgcctgtaatcccagcactttgggaggccaagctggatggatcacgaggtcaggagatcaagatcatcctggccaacacggtgaaaccccgtttctacaaaaaaatacaaaaattagctggcatggtggtgcgtgcctgtaatcccagctactcggggaggctgaagcagaatgacttgcactggggagttggaggttgcagtgagctgagatcgctccactgcactccagcctggcgacagagcaagactccatgtaagaaaaaaaaagaaaaagaaaagacaagactggaaaaagctaatgtctaccaataaagaagtggttaagtaaaccttgacacatacaaacgatggtatcttgcagctattagatatgatatatctaatacatagaaagataaaaaagatagctttgacatattgtagagggaaagaatcaagctgcagaataatttataccatatgccacttttgtaaaaaacaaactaacaaacccacaaaactatattatacctggattttataggtatgtaaatggggagaggattgggattggggctaagcaaaaggaactttagctttatttatattgtttgagtgttttgcagtaagaatgcaatcatgaattatatatgtggaaataaaatatatgtttaacccacagcaagaagaaaggccttcctgctttgaagggcaaatgcattcattcacaatcgggtgttaaatacccactgtaggccagttgctgttggagagaaaaaatgaatgctgccagctgcgtcctggaggctctctctgtctagtagaggagataagacttgtaaaccagtaagtgaaatatgtcagcaaaatatgatctgcgccataggaggcatacgaacaaatgctgtggaacttgtgagagattagttcctggggagaaaaaaggggaggagaaagaagcaagaaagccttcacaggcaaagcagtgtgtgagtttgtggtgtgtgtgtgtgtgtgtgtgtgtggtgtgcgtgtgtatgggggtgtttgtgtggggggtgtgtgcatatgtgtgggggtgtgtgtgcggggatgtgtgtgtgggggggtgtgtgggtgtgtgtgtgtggtgtgtgtgtgtgtgtgtgtgtggtgtatatgtgcagtgtcatgtgcagtatgtaatgtgtgtagtgtggtgtgtgtatacagtgtctatgtggtatgtgcacatatgtatgtggtctgtgtgttgtatgctgtgtgtgtgcgtgtgtggtgtgtgtgcagtgtatatgtggcatgtgcatatgtgtatgtggtctctgtgttgtgtgcatatatgtgtggtgtgtgtgcagttatatgtgacatgtgcacatgtgtatgtggttgtgtgttgtgtgtggtgtgtgtgcagtgtatatgtgacatgtgcatgtgtgcatgcctgtgttcccacatacgcatgtgggcagaggctgaaaggaagtggcggagggactagggaagaaagctgtcagtggggcacatgtgaacagcacagatgagaggtgaatttgggcacgcgggtgagcagtgagcacataggtttgactagcctgatcggggagggtgggttggagacacaagtgagtgacaaaagtagaaagagaggccgaggtaaaagtgctcattcattgagcgagcatttcctgggtgccaattgtgcctcgggccctgtctcctcctcgagaacttcactgtctaatggggagcagggagaagtcgtttgggggcaaatatataattttatattttaaaataactgcaataccacatgcatgcctgactacagaataaaaatggccaggctgagaggtttggattccatttctgaggtgacagagagccccagaaggtgtttgagcggagaagtgacacgctgtgttttaggaatctcaccatggcactgtgtgtgcggtggattctcaaggcagggagctgaacagagtggctgcaacaggtctagccagaggaggttgagacaatggtctggccaggaggtaataggagcctacgtaggggagtgaagaggagagagaatgggaaacaacagatctgagcactattgtaatgggaagattgtcagggtttggtgagtttggtcttgaacatattgcctttgaagtatttttggaaacacccgagcaggggtgcgtcacaggaagctgcataaaaggatccgaggaaggccagctggctggagataatggcagatccaggagtcctggcttgtggtggaggacaaagtgtgggagagatcagtcaaggagaacgttgacgggatgagtagaggaaagaaggtcactctggaatctctcaggatccaacagaataggaagagacctagggaaagaggccaggatttcatttccccaggacagtcacagaagagtcaacagaggattcggttctggcacctccaccccaaacttgggctactatcttccaagggcgggagggccctctgattctgtttgtgcagctggcactggccatggagagccgcctctgggagttgaccgggtgaggaagaaacaagaagacagggcctcaactacagcatggaggtgggtggatgtacctggacactcaggatatcagggctgctaacagcatcaaaggactcatggcagcctctgattggcttagggtggtcatgtccatggtggtggtgctctgcccctttgccttcatggtgttgtttgctggcttcttcccaatagtttcctttgagacgcaaattttccaggccacagaagaggagagaaggagcagacacgtcctccggcctgtgcgtgaatgcaggactttggttcacccgtggtgagcggcaggcatcttctatgaccctggattaaaggctccttcaatatagatttttgtctttatgtcactcagatgtcatttttccatgaataaagggcaagctgagtctagccttcaaggactctatgatttggctccatattgctgagctgtgcctgttagcttcaatgtgtgcctcctgatccactctccaccctctgtcatcctgccctccacccaagaggcgacctagagcggctccctggcttctgttgggctcagccaaagggaagctctaggacacctgaggaagggaggactgtgaggtcgcgggatctcagtgtggatcctggttttatggattaagcttgcagtgttaccagcccacagttacgaacaacatgttagattcgaaagggaatctctatttagaatgagaaaagaaatggtgacaaattacactttttaaaaagcttacaaacaacacagtatcacaaaacgtagaaaaataacgatatttttcttaattgcctagaaaactctacaatacctttttcccatatctttctgctgcatatactttacatctcatacaacaactgtgtaatataatttcccacagaaagaatggaaatataacgcagtcttcagtaggcttggttgaaattttattttattttattttattttttgagatggagtcttgctctgtcacccaggctggagtgcagtggtgcaatctcagctcactgcaacctctgcctcctaggttcaagcgattctcctgtctcagcctcccgagtaccggggattacaggcacgcgccaccacacccagctaatttttgtatttttagtagagatggggttttgccatgttggccaggctggtcttgaactcctgacctcaggtgatccacctgcctcagccacccaaagtgctgggattacaggagtgagccaccgtgcccagcctgaaattttatttttatcattgatcatctacaactgtttcagtttcaccactcattgtaacatcatgtggaattttgagattattgtcaaatgatggaatgtcaaatgatggaacattatcattttcttccatatataactaagatttcagacatttcaaatttcctggtgcaggaagtaatcttcattactctttgagctgatgacacttataagtcagtttgtctttggtgtccccattgtagtgatgtatcatgagaagtccatttgtctttggtgtccccattgcagtgatgtacatgagaagtcagtttgtctttggtgtccccattgtagtgatgtatcatgagacctacgttatcatctgtggagggagctgtggccaccgcacagatcccctcttcaggccaacacagccatccttcagctgctggggatatcagattggctgaggccatatttctgatcagcttctcccaatcctgccatcctcatttcctcacacatatgtctcctgagagcactccacggtaagcctccggcccacaactttccatttcatggtcagcctccagggaacccaatctaagacagcttcaaagatgtcagcattttttatcaaagtagcaagaaatgtaaagcttttcccagtgagttaatatgttttactttcctttaacaataagattaccagctggtccaagggcctttatttctacctgccttttctttcttcttcttaaaaaattactacttttggtacgatctgaaatgttattatgcttataggctacaaacacagatgtttaagaatttctgaagggtgagattccattttaagagaaaatagtatggtgtatttagagttgcatgtactacattatgtttctgaccaagagaactgaattctccacttaaaattgtacgtctgatgatgggaagaatttgccataggctatcttctggttccataccttacaaacctctgttctcttccactaaccacatacatattgcaatatgacctgtcatcaccttcaagtcatgacaccaggtgagttggaggtgagagtattcctgaaagccattttgacatcaggacagctagtgatgaattaagtatattcagaagtgactgtgggctgggtgcagtggctcatgcctataatcccaacactttgggaggccgaggtgggcggatcacttgaagtcaggagatcgagaccagcctggacaacatggtaaaacctcatctctactaaaaatacaagaattagctggctatggtggtgcacacctgtaatcccagctactcgggaggctgaggcaagagaatcacttgaacccgggaggcggaggttgcagtgagctgagattgcaccattgcactccagcctgggtgacagagtgagactccatcctaaagaaaaaaaaaagtggctgtgagcaacttacatatacccaaccaaaccaaaacccatctcccccttaaccagatcctaaaaatgcccgcaacgactccaaagccacccaaccatgagatatgtatagtggagggaaactgggatgaaactatcttacttttgcaaaatttacaaaatgtgtgacatatgaatacatcgctagaactcctcccggctttggaagtcacctgtgcaagcgtgggatcctgaagcttaaacttcgccagcgtcactacaaatccagctctgcctgggtctctccctgcaaggttgcctccagcttactgtgcccctggactgaagtcttctgttccttccaagtcaagttgctctgcaggactctctgttctggtctttgtctctttgtgcctagaggtgataacaccttggctcttactaagaccagttaactgcactattctttgtggtttccctgtgatcacacctatgcaaataaactatcctggaactatcccattttaattgtgtcctctgtttgctgttgggactctgaccagtcatcactcactcttccccaacaaacacccctatttccctcaagctgcccctaactctctcccttcctcaccccatccccagcttacaccatctgcctccccgaaacgtcctaagcaaaccctgcccattcttccaggcccagctgatcccatcctcctccccagccagagtggtgctcaggaagccctgccgggtcaatgcatgtttgaacattatctgggcagtgtctgcctgcagaagctccagggaaggaggaggggttcctgaagatatcgatttcataattaggcctcagagaaagaggctcttggaagcatctttcctggagaccagaatcactgcttaccccaccacggagggaggccctgtcaaaatgaaggaggttccttccctctcctgggtgaggggctgggattccctctgtctgtgagtatgggagtgattaaaagggaggctggctgagtgccttacacaaatcatttccagccacacacccgagggacactgcaggaatgcagggccgaacacaaacgcatccttcctgctgggcctggctcagaagagaaagtcatgtcagacccggggaagggagcttctgggtggacagtgggtagaacagcaggaatcccaggcgagcagagtccagggctcctcctccgaggctccatgaagtaactcatgcaggaagagatgggaaacagcctctgcccaggttaatgggagcgagtcatggccacctcccaggaaaggagactgggaaaacagcaggacctaggccttttcttccacagggcagagcagtctggggaggcttcgctgctgcccaggcaggagacggccatgaggacatgtatattcctgcggtgaaaaaaacggaggcccaattttggccacagaggagattcctatcacggagagtgcagggactctgcctagcatttgaggcacttcaggaaaagcagaatggagcatggcacccaactctccactctgactttctgagtcttgagccccaaaatgtaggtactttcaaacaagaaaagtaccaagaaagagtcttttgtagtttgcaagcatgatgattcggttttgagaggtgcctccctcaaaccttgtagacgtcgtcatcggcacattacctgcctgatgtgaaaaagagaaagaaaaaaaggtagcaaatatctggggattttctttcactggttgcttttaaatgctttaaaattaagagacatttttatcccctttataaaactggaaagatatgccagtttaaaggtaaggaagtgggctggcatggtggctcatgcctgtaatcccagcactttgggaggccgaagcaggtggatcacctgaggtgaggagatcaagaccagcctggccaacatggcgaaaccccgtctctactaaaaatacaaaaattagctgggtgtggggggtgcgcctgtagtcccagctactcgggaggctgaggcaggagaatcgcttgagccagggaggccccagctactcgggaggctgaggcaggagaatcacttgaacccgggaggcagaggttgtggtgagccaagatcacaccactgcactccagcctgggtggcagaatgagactctctcagaaatgaaaaacaaaaaaataaaaaaataaaggtaaggaagtggctgattacctcttggttcacacgtgggtgtatgggcatgggccatggtggtgtggtcatagtcggtagaacatgtgtgtagatatagatataaatgtagctgtagacagagatagagatatatgtcacagtcagtggaacttaatattaaacattcgtggaaagagctgtcagtgctgaccacaggcagctgatctgtgacctacaccagcctctactgctaaaattattgtgaccttaagcaagtcagtttcctattctgagcctaagtgttctcatctataaatgaggtaattggactagatattactattgtttctgccgggcgcggtggctcacacctgtaatgccagcactttggcaggctgaggcaggcagatcacaaggtcaggagtttgagaccagcctgaccagtatggtgaaaccccgtctctactaaaaatacaaaaattagccgggcatggtggtgggtgcctataatcccagctactggggaggctgaggcagaagagtcgtttgaacccgggaggcagaggttgcatgagccaagatcgcgccactgcactccagcctgggcgacagagcgagactccatctcaaaaaaaaaaaaaaaaaaaaaatcgatgcttctagtaaaaccaattgtagcccattaagagagtagtttttagtgctcccgttaggtaagtgtattctgctttgtgcggctcagtaagaaagccaggagccataatacttgggttcccatgttgactctgcctgtttccatctgatgagcttggataagacagcatgtctctctgagcctcagtttcaggaaaggatccatcacttctccaaagctcatgtgctccgatcttgtctcattccccagagaaaggctttgtggtgcaaaaaccaaaatgtctcggttctcattttgtcacttccagctaaggagacaggcatttctgagccttctcccttaggcaccctatcacaaataataaacattagtccatcctatatcctgacttaagaggcacctcaaaatataatcccctggggcttaatggagcataaatacacagcagatgaaagcatcttggggttttccgcatgtaagctcccattaccttcttaagctgagtcacggtccctgaccacattctcctcttggatggctcaaggtggccagactagttatgggaccatttgggagaggagaagacccatttccttctggcagttttccatgatcttgaattctagaaccaaaaagaacaccccactgagcctcaattcctcggattgggtaaggccacccttcctgctaattgatcggtaacagaacatgacacataacttccataaacacaggagctggaaagaggggtgtttccatgaggcagcaggtggagtaggtaagtacggaggccctcgaagcactggctttggatcagacaaacccagatttgattctggatggactactttctagctgtgtgagcttgagtgagttacttaacctctctgaacctcagtttccccctctgtaaatatctacttcccagcatgatcatgaggtgtagacatactatctaaagagcagtagtctcagtgcaggggctcgcatgtatctggggctcaataaattctagctcctcctcccttctccttcctttcacaaaataatattagaaacgtgacaagtcgatgactgttagcttggtagcatcatgaacccatcatatcaggcctgtacctaactcttcaggttactattatcccctaacctcttaccttctctgatctagtcacagatcagagaaccacccacccattctcaaatcacaccctacactgtgccattgtgtgtgcaattctttgcctagactgccctccccaatctccacatggccaagtatttctcatttttcaaggtccagttcatctatttctgtctccccattgccctcaatactggcagcaaggccctgttcaaatgccatgttatgtgggaagcactccctcacttctaactggaagtaaacgctgcctcttctaagtgaacgcagaggttttgctgtgtgtctcatcatttttcccttctataataaagaagtaagaataccagcccctatccctccaccagctgactaggaagctctttgagaaggatcaacattgcgtatgcatcatcctggaaaccctcaggagaaaactctgaacagagcagaaacccagcaaatactattgagtgaatacatgaagggagattaatatatttggagatgctgagaaagagaaactgtactcttcagacagggagtagaagggaaagagaagttacactgtctgcatacctgctgtgtgagatagatatcgcagttcctagttacagaggaagaaaatgaagctcgtggaagctaagtaacgatgttatgcaaccattaatgggtccagctacatgggcactttccccagagagctgggcatgtgtcatttcatgtaatactcacaacaacccgtatgaagcagtctgattctcattttgtagatgaagaagctgaggctagaagaaattaagtaggtaacccaagtttacaaagttcatggagtgagggctgtcagtttatacccagcctatcagatgtggataattggtgggtacttcgttttctgtaactgatcattttgtcctctagaatcccaaatcccactgaagagcaggaaacaaacaaaaacttgtcaagtcaaagatctcatgttttttgccggggaagggaggtaaaaagaatttctgtttctgtctttgttttttccgttgtctatttcttttgaacagtactgtgttccaataattcaaggctcaaacttccttccaggcctgtttgtccttctctgagctttcctctttccctcctccctgcaggaaggctagtccttgtcccatcccctgagttctcgccaccttaggaggagaagtccctcgtgtgcctgctcccagggcccagttcacacctgcagctaaagtccgtgccagaggacatgtctgttctcttggccctgggctcatctgaggcctggtgttcacccctctccccttcttcttgctgctggttctgtgccgccccagcttttcccagtacagccaacctgggcctccacctgtgtcttgtggtgtggacaatcgtcacagcatctgctgtgggtcacctcccccttgccatagaggactgctgccctcagctgacctctcagtgaccttctgctttccccagtgggccctcagaggcttccagatcaggctggggagcacagaggcgaggcgtagtccttcctcaggccagctgtctctccgcgaggccacccaggtcactgtgaggccgtccgcagggcagtctcctcccaggatttctttagcaggaggggatacaaaccactcttggaaattccccctgctgaactcacttctaatcttctccctgtgggttcggcccggccagtgagccaggccacaagtgtctggccacttgccctcctccttcccttccctcttgcctcccactccccacaaaccccttctccatgccaccttgatgttgaaagggttcctgtcccctctgctgtttacagatctgcttcctataccacattctcctctttcccgagatgccattcatcattttccctttcctagagccatagtggcaaaatggatgcaaggaaaatatataaggaaggtgtcctgggggccgggcgtggtggctcatgcctgtaatcccagcactttgggaggccgaggctggtggatcatctgaggtcaagagttcaagaccagcctggctaaatggtgaaaccccgtctctactaaaaaatgcaaaaattagctaggcgtggtggcgggcgcctgtaatccgagctacttgggaggttgaggcaggagaattgcttgaatccgggaggtggaggttgcagtgagccgcgatcacaccactgcactccagcctgggcgaaagagtgagaccctgtctccaaaaaaaaaaaaaaaaaagaaaaaggaaggtatcttggaaaataccactctgagtccacgtgtagcagcaggaattaaacccaaatgcatccagcactaaagctttctgttaagcaccattttagacaccccaatactacagaactagagtaggtggatctgagatttgaacacaggtctaaaccaacctcaaaatccaagcttttccaattaaccgtttttctccttcctctttcaccaacagaccctgcccactccagggtctaccgggtccctgctatgggtcgcctccccggtgaatcgacttctaatcttctctagggtctgcttcaggggcagggtctaacggtggaagaaagaagaaagaccctagtctttatcttactggggtttccatacttagcaaatcaaagtataggatgcaggggtccgcattctctaacagcctgaacaggagtccttgagccttcacttcagcaccagctcctacttcctccctccctgcaagcagagcccacaggtatctccaacgttgacctgagaatgttttcagagcagaaatgcagaagatctttctttcaaagcacacatgcctttgttccctgctttggatcacttaaggcaggcttgagcagcctcttaataggtttgttttgcggttggtttattcctccgttggggtgagtagacttcacttagctgcataggggaagaaaggcagtttgtaagccaagcggagcagcaaatgtcagatcaggctgaaggctgctgaagtttcccacaggccccaaacaccctcttgaacgacttactctgccggtttagtgcaagggtggttttctttctcccccctcagccggacctttgggatctgttttactcacctggaaagttgcataatcttgacaagcacaaagcaattaagagattcctagctcctgctgctgctgctgctgctgctgctgctgctgctgctgcttctactatacactggtaggtggaagaagggacactggcctctaggattaaagactctgccttcatcggtaagtagacgtagagagcagacgcaattccacagatcattctcatcaatgtaaactacatgtgcccaaaatatgttgggtcataaatttcaggtagacacaaaagtaatgcacctccttgattacctcagttatttacaattggcttggagaaatctagtctaaggatttaatttagtaaacatgcattgagttcctgatgcacaaaaggaaggccctggtcaggtcagagctttgattacaaaaataactaagacatggtcttaaacctcacgtggttcctggctgctggtggtggcggggaggggagaaaatgacaatatgaaatgtctgctccccttaagaaaattctccctgtcttagaggggaacatcacacaatgggacctgtcggggtgtcgggggcaaggggagggatagcattaggagaaatacccaatgtagatgacgagttgatgggtgcagcaaaccaccatggcacatgtatacctgtgtaacaaacctgcatgttctgcacatgtattctggaacttaaagtatataaaaaaaaaaataaagaagaagaaagaaagaaaattcttcgtgtcttaagcctgtcccctacccctttgcttcaaatcctggtttccaggaagattgattgacatgtatcacctcccagtccccgcctgcatctgctccctgcagtcctctgacttagctttaactaccatatctacttgcagattttagtctttctcttactagggttcccatacttagcaagtcaaagtaatatacatacttatacttaaaaagtattcattttggggaaggtggggatggttaacgggtacaaaaaatagaaagaatgaataagacctactatttgatagcacagcgaggtgaccgtaggcataatagctctattgtacatttttaaataactaaaagagcgtaactggattgtttgtaacacaaaggataaacgcttgcgggaatggataccccattctccatgatgtgatcatttcacagtgcaggcctgtgtcaaaacatctcatgtaccccattaagatatacacctactaggtacccacaaaaattaaaataaaaaatgtgttaattaaacaatatttttaaagtattcatttctatctgaatgcaaatttaactggacatgctgtattttatctagcaacgctgtgtcttactagacttatctgcttgctctaacctggtgactgttccttccttcttaaaatgatcttcttcttaagcagatgtaacattgactgacgtggctctctcctgatcatcctccctccccttggaccacccactcagtctctttcacagcctccccttcccctccatgatccttaaatgttgagctccattagagctccagcctctgttcttctccctccctcagtcttcccaggacatcttcaacacctcgtcttcaatgacctcagccaaggtggcatctgcttgatgagtcttcctctagcttagagagaatactttcttgagctcactccaatctctatgcttcatggtctcttgggcaactccaagcaagatgtaccacaggtttcccaagatcagcatgttgcagattttttatttatttatgtatttatttttggggtgcagtggcatgatctcggctcactgcaacttctgcctcccgagttcaaacaattctcctgcctcagcctcctgagtagctggggttacaggcatgcgccaccacacccagctaatttttttgtatttttggtaaagacaggatttcaccatgttggtcaggccggtctcgaactcctaatctcgtgatctgcccgcctcgccttcccaaagtgctgggattgcaggcgtgagccaccgcgcccagccgcatgttgcaaattttactcatttgttccctctccatttctactcttcccaatcccagtgaatttaccccaccatccaacccaatactcaagtcagaaacccagcagtggctcttgattttgtcctcttccttcccgcaacccccacatctaatttgtctccttgcaggttagattctatcttctaaagatttttcatctgtccccgtttgctctctgccactgccctcttacagaccatcatcatctctcacctcgaccgtggcggcagcctcctaagtggtctctctgcctccattcctcctctatattccacaacatcccctgaaggatgttgctaacacaaaagtcatattatagccttcccttatttcattggtttctcatcaatcattgggcagcttgacccatgggactcttcaccacttctccaagtttatctgctgacacagaacaaccccagccataccgaaaatagtctctcttccccaagcatatgatttggtctccgagtctgatttacatgtatcagggctttctgcagcacactcctacctgcactggaaaccatggaaaactactcatcctccaagcctcaagtcaggctttgcctcttcgcagaagcctctctacattctccaaggaaacgtggagggggagtatactccatgctctgtgttcctatagctgctagagtctagcaccttgtactaacctcattagaaagccctctagaggacagatctgtttgcaagtcttgaatttactgtaattgattacacatgaccagaccctgagctcctggaacacagagaccatatcttttattagctttgttttgttaatatctagaactttaaaaatatctgtaagaatacagaaactaatacaaccaacacctgtgtttcaattgaccagagttgacccctattaatatttgggtgtatttgcttccaatctcatccctttgactctattctcttccctcagaagcaaaattgtaagcaagacaagcagacaagggatcctggagtgagggtttgagaagagttggaaggccaggtacggtggctcacacctgtaatcccagcactttgggaggctgaggccggtagatcatgaggtcaggaaatcgagaccatcccagccaacatggtgaaaccccatctcaactaaaaatacaaaaattagctgggcgtggtggcgcgtgcctgtaatcccagctactcggggtgggggctgaggcaggagaatcgcttgaacccaggaggcagaggttgcagtcagccaagatcatgccattgcactccaacctggcaacagagtgagactccatctcaaaaaactaaaaatttaaatttaaaaaaaaaagagctggagttgggtggaggatgatctgggaggtacagaaatgagacaagtggaatcggtcaaagcattcttgtaacagactttgaaacggcagaagtccacatatttttcttgaaaatgcccattttctttgtaaggccgaggtgggtggatcacctgaggtcaggagttcaagaccagcccgaccaacatggagaaaccccctctctactaaaaatacaaaattagccaggtgtggtggcgcatgcctgtaatcccagctattcaggaggctgaggcaggagaatcgcttgaacacgggaggcagaggtcgcaatgagccgagattgcaccattgcacttcagcctgggcaacaagagtgaaactccatcccaaaaaaagcaaaaaatttgcccgttttcccatagactgatggcccactttagctgtatgtatactggtggcaaactgaaaacattaaatgaaagaaaatcttattttatgtggttttagcttagcaaaaaaatttttttagaagacggcatcactttaaaactctggcaaaatttattttcagtttcttttggtgtttattacaaaaaaaaaaccaataaagcaaaaacaaacaaacaaaccgaaacctctctcaaacagcctggaagactctgcaccaaaatattaattgtgattatctttgggtggtagcattagagaccattttcttttgtttgcctgtctgcctttttcaaagtaatgaagaaaagtaatgcaggagagcaatgaggaagagtgatagcaaatgaggcaatgaagaagagaatcatgcctttaaaaatatattctcagtaatattcagggaaaggtaaacagtttgagaatttttttcatgatagacagaagatttgaagagaggaagagtattcgttggcagcctagaacttacagcttgcactttagtgagatttctccctatcaagattatggattggctgtaccacccagggaacaaacagctgacctcaaatcacatgccgatatgttcacaattaaacaatcactgaagaagctgtaaagcacagaaaatgtgtagtagttaaaaataatcaacaaatgaagcttctgtgttttcttgcctgagaacaaggggctgttcttctagtctttataatgaaatagtgagactctgtggaaaaagatacagcagttggtaaatgttctaaacggagcattgcaaatatgtcataaacccaagtgcttctgagttcacctgtgactgggtaagaacgcaggacaggctgcgagcaggtggtcagtgggcctctagatattaattcactgcagaaagcggccattacgaaatttcatttttttctttcttaaagtcaaattcctgattttggtttttaaaacaggagaagtatttcataatgagaaagtgatttatgtagagtttttccacatatgttactgaaacaaggttgtgctttttgtttgtttgtttgtttgtttttgagccagagtctcgctctgtcacccaggctggagagcaatggctgatcttggctcgctgtaacctctgcctcctgggttcaagcaattctcctgcctcagcctctcgagtagctgggatttcaggcgcccaccaccatgcccaggtaatttttatatttttagtagagatggggtttcaccaggttggccaggctgatctcaaactcctgacctcaggtgatccacctgcctcagcctcccaaagtgctgggatcacaggcgtgagccaccacttccggctgccttttttttttaaaggtaacatccctgttcaaagacagattacaggtggtaaaaaaaaaaaaaaaacagttgagaaagccttgcaaagtgtccattttgaaagcggaacacctttctctgttgtgtttattcatgtgcatttggcatagcgaggtgaaaaccaacgtcctgctccattctcctaattcgatgctcacttcagtttccatgatttttgttccccttgctacctgggggaggagagttgtgctaatgcttaatttttggacatccaaatggtggggatagtttgtggcaacccctccactagccagtcctgaaatacctttttagtgtggggtcagacatccacatttccctgaggaagctttcctggacagcttgccaggatgccgcagggtgcaaccaaatactagagtatgaaatggaagaggcggtggcggtatgtgcgcttgatgggcagtgaactgaggatggcaggtcagcctgctgggctctattcccacaaatgtcctttagagagttgaccttctctttgctgggccgaactctattagataccatgtggaattctggtgataggagggaaataattggagacatttatttattcactcagtcaacaaatctttattgggcatccgcaatgtgttaggtgctaataaatgcaaataattttacaaagaatagaaagttagacccatgaaagtatttcaaaatttacagtgagttttcatctgtgtcacttcaaagaagataaaacaggcatggtccttgcattcaaaaattcataatctagtaggtgagataaaatacgtagataaatcattacattacagagtagaatacaatacaggtcactagagaaagggccagaccctgaccagggaatgaacagctgtgctggagtcacatgccagtgcttgcacagctcagagctgaaaaaagggagaggtcacatccagctctggttccagctgtgtctgagtaagatgcacatgatggaatctggacatgcgaatagggagaatagagtggttgtactttcgtcaccttcaaaatacttaaaggggcacactcttggttgtggtttgtggctcaacatcttctggaggatgtgcatcttctggaggatgtgcacaacaaccatttggttgcctttgcagaacctgtaccctgtactttgtttgtttggttgttgagacagagtctcgctctgtcgcccaggctggagtgcagtggtgcgatcttggctcactgcaacctccgcctcctgggttcaagtgattctcctgcctcagcctcctgagtagctgggattacagacatgcaccaccacgcccagctaatttttgtatttttagtagagacagggtttccccttgatggccaggatggtctcaaactcctgacctcaggtgatctacctgcctcagcttcccagactgctaggattacaggcgtcagccaccttgcccggcctgaacctgtactttaaaatttaaaaacatttttggagcccacaagatagtcgaattgtggctgataattcatgtggaattaggccaggtgcagtggctcacacccataatcccagcactttgagaggccgaggcgggcggatcacttgagatcaggagttcgagaccagcctggccaacatggtgaaaccccgtctctactaaaaatacaaaaattagccaggtgtagtggcgggcgcctgtaatcccaactactcaggaggctgaggcaggagaatcacttgaacctgggagatggaggttgcagtgagccaagatccgccactacactccagcctgagcgatagagtgagactccatcccaaaataataataacaataataacaataataataataattcatgtgaaattaaacctattgacagtggtcaataggcctaaaagtctcacttttaggccattttctaaagcaccacaatttagggaataatttttttttcaattgtgggggataatttatagacctcagtgactcagattattaacttggtcctaaaatttataattcttcaatacaagttcataaatattcatcctggtgcctaggggagacctctcttggctaagagatagttattcagtaaacattttttgtttcaactctttattctgataaatattctaatacagtatggaaggatttattgccttgataatgaggatacattatttttttctttggtaatttcatatcttgtggtgtctcaaatttcttattctgagtgccagttgccattgaacaggactatagataaggaagatatgagaattataaacaaatgtggacttatatcagaagcttccttgaaatcaaggaacttgctaaacgtcctctggtataagtgtatgtgtgtgttgttcttctacaaagataatttaaaaagaattttaaaaagtaggaattcgttagagattctgattagtctgatattttgtatttctggctttgcttataatttgctgcattcacctggttttctgactctcatgtcctgatggtctgtgtccaagcaggtaaacacctgccttagaaggtcttccacgttcacacagcaaaagaaattagggaatctgccaagttctcgagctcaacgtatccttctttttccagttggttgaaatgaacaactagtatgcctcttaggaacacacacaataatctgaattcttggtttgactaaataaaaaatagaaagtaatcatatttatttaaagataaaatccgctagtatcacttgaaatcaaaagccacatagaatgaacttggtttcaatgagtcaaaagatttctaatacgcctctgtgatgagatggaaatgaagatgagaagcaaacttaagtctactgacaaatatagaaaatgtttcacgtcctgaatgagtgtgtccgtgtttttctgtttccatctggatccttttcagtgtgattacttatttttaggttggcattttagcaggaagatgaaatggcttcaggaaatagtgtgaaaggttaagaagatgggtgagaagtgtaagtcgagagccgtcataagggaaaacgtggcctcacagttttacgttcagtgcatctctagaaaaactaaatatccatatttctgctcaattcctatcattgaaccttgtaaacttgagtagctatgccgtagtgtcaaggattattagagaaagtatggaacttgaagacacgtaagtataggagaggcagtgtaaccaaataatgaagtggaaaacaggccctaaaatgggaatgtgctattttttctttttctttctttttattttttgggagagagagtctttctctgtcacccaggctggagtgcagtggtgcaatctcagctcactgccacctcagcctccctggttcaagtgattctcctgcctcagcctcccgagtagctgggattacaggcacccgccaccacgctcggctaatttttatatttttagtagagatggggtttctccatgttggtcaggctggtctcgaactcctgaccttgtgatgcacccgccttggcctcccaaagtgctgggattacaagtgtgagccaccgcacccggccatgtgctattttttctgaaagcctttagagtcatatgggagaaggaggtatgaactagaacaagcagcaatttggtaatgttattcatgttgaacccaggcaacctaccaaaactgaatgacataatcttcaaaatagtcttgaggaaagaagcccttagaatatgcataaatacttgtttttttataacaggttgataagtccaagctattttaaaacgcttcatattctcctcactcctttatgtagtgagtaaccagtgaggtagtcagctctggctatgcctttagggcagccaccgaggagggcaccagaacaaatcagagtgatgaccgcctcctctgctgtttcgacactccccactcatctttggtgcatgccaatcctggccccttctgcctcccaatcctggccccttctgccttccaatcctggccccttctgcctcccaatcctggccccttctgactcctgattgtaggttgccctcgggtttcgcatccaacttctggaccgggtttggtatttgctcacacttggctgaatcagggctgtcagtcaatatttcagctcatattcatcatttaaaatctttccactacaaggccgggcgcggtggctcacacctgtaatcccagcactttgggaggccgaggcgggcagatcaccagaggtcaggagttcaagaccagcctggccaacgtggtgaaaccccgtctctactaaatatacaaaaattagctgggtgtggtggcaggtgcctgtaatcccagctactcaggaggctgaggcaagagaatcactcaaaccctggaggcggaggttgcagtgagccaagattgcaccattgcactccagcctgggcgacaagagcaaaactccacctcaaaaaaataaaataatgggtgcagcacaccaacatggcacatgtatacatatgtaacaaacctgcacgttgtgcacatgtaccctagaaattaaagtataataaagtaaataaataaataagtaaaataaaataaaataaaatctttccactgcaggctgcattggtgactctttctggactccattcccagcctggctcctgcctacgtagacgcagcctcagccagaagccctggtcctgatgaaagggaagtccagcaagaattcttttttgtttgtttgtttgtttttgctgttgttgttgatgttagacagtctcgctctgtcgtccaggctggagtgcagtggcgcaatctcggctcactgcaacacccgcctcccaggttcaagtgattctcctgcctcagcctcccgagtagctgggattacaggcacacgccaccacgcccagctaatgtttgtatttttagtacagatggggtttcaccatgttggccaggatggtctcgatctctttacctcgtgatgtgcccgcctgggcctccccaagtgctgggattacaggagtgagccaccgctcccggccgcaagagttctaattctcactttgtaaggatggagacgtccacacagtgggacctttccttccttgcccgcactgcctccactatgtggagctggtcctgtacactgatctgttgttaactgaatacatccttcctgcacagacactaaagagggcctttcctgttctccacccttatgtttccctccctcctgatttttctttcttccaaagcttttgctggactcttcctatgagccaaaacctacattaggtgctagaattataaagatactatccctgccttctataaactcatattctagtggcttctgccttgaagaaataggaccaatcgagcaccgtatgttcatacacttattcaacattttgggggttttgcctttgtttaacgtggagaggaatatgagttcatttgctccttgtttcatgctggctacttaattaagtaaaagatttaggaagagctttgaggataaaatgtatctttagggagctgttaacttaaccagcccaacctgaagtctccagcaaaactttttattcccataatgtaagtttgttaacttaaaaaattatttaaaataattataggctcacagaaactttcaaaaatagagtctatactctacacgtgtggtggctcatgcctgtaatcccaggactttgggaggccgaggcgggtggattacttgaggtcaggagttcgagaccagcctggtcaatatggtgaaaccctctctctaatacaaatacaaaaattagccggccatggtggcatatgcctgcaatcccagctactcgggaggctgaggcaggagaaccgcttgaacctgggagatggcggttgcagtgagccgagattgtgccactgcaccttagcctgggcaacagagcgagactctgtctcaaaaaaagaaaaaaatagagtatagtctcttgaacccaacttccccaagggtgacatcttgtatgactgaagtacaatatctaaactgacactgacattggtacaacactagtaagtatgcaacagaccttgttcagttttcaccaatttttatatgaacccatttgtgtgtacgcatgtgagtgtgtagttctatgcaacttgcaatttaaccctgcatatagattgtgtaaccaccacaacaatcaagatacaaaactattccatcaccaaaaagcaactcccttttctttagggtgataccttcctaacccatccctgtttcctaacaaccacgaacctgctctccatctctacagttttgccatttgagggtgttatgtaaatgaaatcatataggatataactttttgagatcaccttttatcactacacacaatatacccttataatcctttcaagttgcatgtatgaggagttcattccttttcattgctgagtagtatgccattgtagggatgtaccagagtctgttcaaccatttacccactgaaggacatttattttgtttccagttttatattaatacagataaagttgctatcaatgccaatgtacagtttgtgttcatttctctaagataaatgcccaagggtgtaattgttcagtataataagtgcacatttattttgataagaaacaacctgttagataggtttttttgtttttgttttgttttgttttttgagatggagtctcgctctgtcactcaggctggagtgcagtggcatgatctcggcttactgcaacctctgcttcctgggctcaagtcattctccagcctcagcctcccgagtagctgggattacaggcgcacaccactatgcccagataagttttgcattttttattagagatgggatttcgccctgttgtccaggctagtatcaaactcctgacctcaggtgatctgcctacctcagcctcccaaagcgctgggattacaggcatgacccaccctgcctggcctttttttaatttttgagacagggtctcactctgttgcccaagctggagttcagtgactcaatcatggctcactgtagcctcgacctcccaggttcaagtgatcctcccacctctgcctcctgagtagctgggactacaggaaggtgccactgcactcggctaattttttattttttgtagagacaggtcttactgtgttgcccaggctggtctcaaactcctgggctcaagagatccttcctcctgccttggcctcccaaagtgccaggagatagtttttaaaaacagctttatagaaataaaattgacatgcaataaactgcacatattgaaactgtacattataagtcttggcaaaagtatatgccctgaaaccattaccacaataaagataacaaacacattattctttactccccaaaagttttcttgtggccctttgtaatctattcttcctgcccttgcctgccccccacaacccatcccaaggcaacactgatctgctttctgtcactatcagttagtttgcagtttctagaatttgatataaatgagagtttgttctttggtgggggcaggatctagcttctttcactagcataattatttttgtattcacccatgttgtcatgtgtatcagtaactaattcattcttactgctgagtggtattccattatattgatgtaccatgatttgttgatccatttatctgttgatgaacacttgggttgtttacagtttggggcccttgccaaaaaagctgctataaacatgcctagtggatgtcctcagaagtagcccaactccctggaacctgagacaaaaagagagaaagagagagcaagtaagaaggaggggctctggcttctgccagagaaaggtccagatgattgtgccagaacagaagcaccagcaaatagcacctttcatttgtgtggcactttgaagttcacaaaaacttttcaccttcattgtcttccataacttacacaacatccttccctggcaactgggacaggcattactatcaccaattgacagataagaaaactggtgctcagacatattgaagtgacttggctaggggtcatataagcaccagagtctaagggcattattaatcattcttactgtcctatgacctcttccattctggtgtttaggaaaaaagctcagcttctccacctcaagaaattgtggcacacacacaaacctgattgactctccagagttctttaacgtacctgactccctttgttaaattgtttaaggaaaaataaaagatatttgctaccactaccagtttcccctggagtacaaaagccattgtgctatggattggcaggattcaaccgtctttttcttatgaatatattggcatttataagcaggaagtccactgatctatgatgatgatcctgggacacctcctcatcccaagaaccaaatggtgctctgtggagtaggaatatactatatctgaaataaaatgattatgattttatgtggttgacagcagatgagacattgtaaaataaaaggtcaatgcacttaaaaacatagtaatagaaaactttccaaaccaaagcacagagaggaaaaaaaaataaaccaagtcttagtgacctattagacaccatcaagctgtttaacgtacttgtaattagagttccagaagggaaagcagaaaaaatattgaagaaataatagccaaatatatttcaaatttgatgaaaactatgaactcacagatctgagagctcaacaagccacgagacataacaaagacaaaactacatcaagccatatcctaattaagttgcagaaaaccagtgaaaaagaaaaaatcttaaaagacatattacacagtggttcacgcctgtaatcccagaactttgggaggccaaggtaggcagatcacctgaggtctggagtatgagaccagcctggacaacatagtgaaaacccatctctactagaaatacaaaaattagctgggtgtggtggtgggcacgtgtaatcccagctactcgggaggctgaggcaggagaatcgcttgaacccgggaggcacagtttgcagtgagctgagattgtgtcactgcactccagcctgggcaacagagcaacacctcgtctcaacaacaacgacaacaacaaaagacatacatacagaggcacgaagatttttaaaaatactgatgacttctctccagaaataatgcaagccagaaggcaatgggaaggcatttctaaattgctgaaagaaaacaaaaaatggcaaacctagaatcctaaagcctgtggaaaaaatatctcttaaaaacaaagataaaataaagacatcttcagattttaaaaagctgagagaagtaattgccagcagatttttcactataataaatgttaaaaagaatatcttcaggcagaaggaaaaggaaccagacagaaactcaggcttacctaaggaatgaagagttctgaaaatggtagataggtgggtaaatataaaagattttttccgatttttactatatttaaatttaaatggcctgttctaagcaaagttaataatgacatattgtggattttgcaataaataggaatctaaaatgtacagcattgatatgaaggacctaagaaggaaaatggaaatacactgatgtaaagtttttatactatgcttgaagtgctaatattatttgaaggtgggttgtggtaagttaaaaatacatattacaagccctatagcaaccactaaaacataaaacagaattatagctagtaagggaacagtggagataaaatagaatcctaagaaataaatcacttactccaaaagaggtcaggaaaagaagaggtaaaggaacaaagaacagatgagtcaagcagaaaaaaaaaaaagaagtaagcttgtagagttacacctaactatattatgttatagtatattatattaattgatttaattatattaaatgtaatcagtgtaattatattacatgtaaatagtcataacatcctgattaaaaggcagatattatcataatggataaaaaggcaacattcaacttaatactttctacaaaaaaaggagtttaaatatatgaagacaagctggttaaaagtaaaaaaggtagaaagagatacattacacactgactataagaaaactggagcaacaatattaatatcagacaaaatagatttcaggaccaagggtattacagtaataaagacgggtatttcataatgtagacgagttaattcagcaagatgtaacaattctagatggatgtgcagttaataacaaagctttaaaacacatgaaacaaaaactaacaaagggcaaagggcaattagaggaattcacatatagttagaattttccacaaagtcctatttcaataattgatagacaaagtaaatagaaaaacaatagcaatagaaaacatgaacaagttacaaaaaaccagttatagaaaacatgaagaacactatcacccaatttgactcattacgttttctagaacaatatttcccaaaacagcagaatacacgttcttttaaagtacacattgaacattcaccgtctctgatcacaacagaattaaaatagaaattaataactgaagatatatggaaatcctcaaccatttggagtttaacaacataactactaaataacccgttggtaacagaagaaataactagggagacttaaaaaatatttgaactgaacgatatgagcctacactttactagagaagcctctaattaccttctttaatcagccgagggatcagagaaggctattttctctcttaacttgttcactagcccatttcatgtacccttctccccaggataaaacagaggaacagtgttacttaggtccttaacacctagtagtaaggattactatgtatcaggcagtgagcctgcgccaggtacagtgctaattactttaccgacattatctcatccaatcctcacaacattccactgagatgggaggtcttgttacacattttgcaggtaaggaaatggaagtgcagagaggttgacttgttcagatcacaaaattagtatcctggtgccaacattccagtccaagcaggatgacgccggagcccacacgtttgacaccatgccataccagcaccacaaagggcatcgcacaattctaggggaaagaaggagggctatttatattttatgtactaggttttggctacaaaattccctcttattaaatcatagttttagctactttccaaaaaccacgactacctctttctggtttgaaaaagaagcttggaaaagtctccactatgcttacttactacaagacctcaaggactggttaagatgagtcatccgcagcttgaaaagcaatgtacttggaactagaagacactgattatcagctctgttgcctcaggcaagtcacttctctgggcctcgatttcttcatgtgtaaaccagggaaaacaataactaactataaggaatatgtaagaaaacataagtggaagtggtttgtaatctgaaaaataatatatgaatttgaaggaactttttatgtttactgagggaggaccatttaaaaatggatttgatattacttatattaatttaaaatttaagcagcaagatctgatcattcactgtgtttactgtcaatgatgacttatataacactttcacttctgaataagaattttggtataaagatttattttctttgagggtaaagtttaaaaagactagagagtacttaagctgccagcctttgccctgcttatacagagtgctggcaacagaggctgatgcttcataaaaataaacctttagaagtttgtacatataccataacactatgcatcaatatttttaaaatgtacacctcttaatccagtaatttcacttccaagaattcatcttatggataaacatttgtttatctagcatggtttttcataatggaaatctggaagcaaccaatttaataagtatggccatttgataaaacactctatggatgataaaaaaactattctgtaaaagattggtttcttatttacctgagaaattattaatttggggaaaataagtactaaaaagcaaagttttaaaaggaggctacaaaaatagaatgaccatcagcaactgatccagcaatttcacttctgggtgtatacccaaaagaattaaaggtagggtcttgaggagataatttgtccacacatgtttatagcaaccaacaataaaaacaacccaaatgtccatccatagatgaatggatgaacaaaatgaggtacatacatacaatggaatttaattcagccttataaaggaaggaaattctgatacgtgctaccacatggttggaccttgagaacattatgctaagtgaaataagccagctacaaagaagacaaataccgtattagtccacgtgcatgaggcatctagagcagtggaattcctagaggcggaaggtagaacagcgatcgctcgcagcggggagagggaggaatgcagagacactgtttaatgtgtgtacaggttcagttttgcaagatgaaagagctctggggatcgggtgcacaacaatgggaatgtacataacactgctgaactgtacacttaaagatgggtaaggcccagcgcggtggctcacgcctttaatcccagcactttgggaggccgaggcaggtggatcatgaggtcaggagttcaagaccagcctggccaagatggtgaaaccccatctctactaaaagtacaaaaattagccaggcatggtggcaggcacctgtaatcccaactactcaggaggctgaggcaggagaatctcttgaactcgggggggcagaggttgcagtgagctgagatcacgccagtgcagcactccagctggggtgacagtgagattctgtctcagaataaaaaaaaaaagggtaagatggtgtattttatatctattttactataatttaaattttttttaatttacaaagataatgaagagttaatgaggcagataggaaggagtgttttaggccccccaaaaaatgatgttaaaaaatatggcagcacggaagagcatggtacattccgggaactggataggagtttttacggctggatgtgccagacaagattgggactttatctagagaagcagcattgagttgatttgcttaaggtcactcatgaaattgtgggcagaacaccgacaggatcactcagacctgattcccagcttggaaggtgtatgtctgtgtagacatgtgatgtatgtttaacaatcatcataaatgggaaacatctaaataaaacgccggtatcacaacatttaacatttgacgcattaactgagttgtaacatacatcttcccgggggtaaatatcccttgtatagatccttaattttctgtcattatcatgcaccaagcctttttgaagctataaaataaatgtaaattccttaaaaaaagcagactacaaaataacatgtatgatactatttttctaagaaacatatatatatatatatgcatggaaaatactagacatatctacagcaaatgttagttggctgttatctttggcttgtgtgagtttggttaattttttttttcttagtgcttttctgttttctaatgtttcttcactgagcacataaactagaagaaaatattaaagaaaaaggaattcttaggtgcaccccataaaatggcagatctttaaagaatgctttggtaatggtgtcaatcacttcttttgattccaagaagtaataatcctcatataggtgagcttggatctgcagaaggagctggaaatgtcaagagagtggctgttaaccaggagagccccagtccttactaccaccttcttccctctctttttctcttcctcactgtgccatccatccctgttagtctccttctcaactagggtgactttctagtaacccaacacttgtttgatgggctcgctccccagacagccttatgccaaggtgtttaaataccctaggagcagtatgctgggaactggaaggtttctcatgaatggggccatcttagagaactaaattcagcttagaattcactgttttacaaaatgaggtcattttgcctcaaagaaatacaaaaaaaaccctcagagactatcaccaatacttctatgcacacaaaccagaaagcctagaagaaatggataaattcctggaaacatacaacctcccaagattaagctaggaagacattgaaaccctgaacataataagttctgaaactgaatcagtaataaaaagcctaccaaccataaaaagctctggaccagatggattcacagccaaattctaccagacatataaagaagagctggtaccaatcctactgaaactattccaaaaaatttaggaggaggaactcctccctaattcattctatgaggccaatgttattctgataccaaaacctagcagggacacaacaaaaaaagaaagcatcaatatccctgatgaacagagatgcaaaaatcatcaacaaaatactagcaaactgaatccagcaacacatcaaaaagctaatctaccacaatcgagtaggctttattcctgggatgcaaggttcattcaacacatgcaaatcaataaatgtgattagaaccagaaataaagctgcacacctacaaccatctgatctttgacaaagtcagcaaaaacaagcaatgggaaaaggattctctattctataaatggtgctagggtaactggctagctatatgcagaagattgcaactggactctttcctttcaccatatacaaaaatcaacttaagatggattaaagacttaagtgtaaaacctaaaactataaaaccgtagaagaaaacctaggaaataccactctggacataggcactgacaagatttcatgatgaagatgccaaaagcaattgcaacgagaacaaaaattgacaaatgggacctaattaaacaaaaaagcttctgcacagcaaaacaaactaccaacagagtaaacagacaaacctccagaatgggagaaaatattcgcaaactactcatccaacaaaggtctaatatccagagtccgttcttccagaaggaaacaatagacacagggggcctactggagagtggagggtgggaggagggtgaggatcagaaaattatctatcgggtactatgcctgttacccaggtgatgaaataatctgtacaccaaacccccaggacaggcaatttacccctgtaacaaacctgcacatgtacccctgaagctaaaataaatgggggacggggggcaggaaaagaagatgaagagagagagagaaagagacagagggcttatttaaagaaataattcctgaatacttcccaaatctgggaaaagatataaacatccaagtacaggaagatcaaaagtctctaatctgattcaactaaaagaagactataccaagatatatagcaatcaaactgtaaaaaaaaaacaaaaaaaaacaaaaacaaagataaagagagaatcctgaaagcagcaagagaaaaaagatcacccctcataaggctatcagtgggtttctcagcagaaactgcaggccaggagagagtgagatgaacgatctgaaaactataaaacattgatgaaataaattgaagaagacacaaataaataaaagatcaatgaaaaattaatgaattagaaaaattaatattgttaaaatgtccatactttggtcattgctaaatgcccaaagagatctgtagaattaatgcaatccttatcaagagtccagtaatatttttacagaaataattttgagcaaaaagaataaagctagaggcatcatactacctcatctcaaaatatactgtaaagctttagtaatttaaacagcatggtactggcataaaaacagacatattgaccaatggaacagaatagagaacctggaaataacttcatatatttacagtcaattgatctttgacaaagttgccaagaagacacaatgtggaaagcaccgtctcttcaataaatggtgttgggaaaagtggatattgacacacagaagaaaaaaattgcacccttatctcatacagtatataaaaaacaaatcagaaaggattagactgaagagctgaaactggtaaaactactagaagaaaacatggggaaaagctctattacattgatctgagcaatgacttttttggatatgacccccaaaccataggcagagtagaatggtggttgccaggggatatggtgtgtgtatggaaaatgggataacattggccaaaggatacaaactcacagttagacaggatgaacaagtattttacagcacagtgactatagttaataataactttgtgggccgggcgtggtggctcacatctataatcccgggactttaggaggctgaggtgggtgaatcacaaggtcaggagttcaagaccagcctgaccaacatggtgaaaccctgtctctacgaaaatacaaaaattagcttggcgtggtggcacgtgcctgtaaccccagccactcgggaggctgaggcagaaaaattgcttgaacccaggaggtggaggttgcagtgagccgagattgtgccactgcactccggcctaggtgacagagtgagactccatctcagtaaataaataaataaataatagcattgtgtagacttgaaaattgctgaaagagtagattttaaatgttcttgccatcaaaaaatgatgaacatgtgaggttatggatactttaattagctgaaagtaattatttcacaacttttagatctaccaggatattacattgtgaactataaatatacgtaacttctatttgccaattatatctcaataatcctaaaaaataaaatacaggagaaaaaagttgcactacgtttcgaaagcttatccacattgtttaatgtagctctctgtcatcctttgttggtaatgtgacattccattgtgcaaatatatataacttataaaatattttttaaatgaggtcattttggagaagctcaggaggaagcaacaaaaagggagggagaaatgtcaaatgatatgagaacttaagggggaaaagggaaggaagagaaagatgaaggctaaaccattgtgtaggaagacattgtcaatgcttcagcagggacttcagtggaggtgctgaatacagcttctgacggtaaaggtcatgatgccatcacatgcaaatggagagacagactcctcatctcagaaaccaaagaaatctagactcctaaatctgtaatagcaggaagaaccctcactgtaacaggcttgcctctgaatttcccaggcctcattgctgcctttcattctcctcttcccagtctggaaacgtatttccacccttcttcctttgactgctttatcagaccttcagggctcagcccagggcttcctctcttattgcctatcaagttagacttaaattatctgtttctatggacctccttcatttaactctaagtttcttgaaggcaagagctgtgccatattcatctttgtattcatctgtgaatagatggtattaaatattgcttgaactgaactgaactgattgaagaattgagcctttcttgttcttaaggctttcacatttcctacttgaaagcgagcaattttttttttttgaagtgtttctctcttgttgcccaggctggagtgcaatggcatgataagcaatcttttcattgataactaagcttggtgcattgaccaatctctagagcctctggagacccaggctccctctacagccaccaagggcattatccatcagcattatcctcaatagcatcctatatggacaggagggatttccttggggcagagggactgatgcagtaatgctgctgctaatgctcgctctggactggctaaaagagtttgttattcgtgcaataaaatctctgatctaatcacgtccctggaaagctatcttttacattaaagaagactggagtcaaggattttaaagtgccgggcacgatggctcacacctgtaatcccagcactttgggaggctgaggcgggtgaatctcctgaggtcaggagtccgagaccagcctggccaacatggcaaaaaattagccgggtgtggtggcgggtgcctgtaatcccagctactggagaggctgaggcgggtaaatctcctgaggtcaggagtccgagaccagcctggccaacatggcaaaaaattagccgggtgtggtggcgggtgcctgtaatcccagctactggagaggctgaggcaggagaatcgcttgaacccaggaggcggaggttgcagtgagccaagatccctccatagcactccagcctgggcgacagagtgagactccaactcaaaaaataaaaaatttaaaaaaaaattttttaaagcaatcttctcctaaggaatggtgatttctggagtaaaaactttctctgaataggagtttcccttgctcactcctgcaccagccttctctccatgaccaaattcataaggcactcagcaagactctgtgctcagagcccaattgcaacacacagtacaattatgctgaccatgccaaatactttggctttggagaatagatctattaaccccagcaacgtggttgtgttcctcaagcgatcctagcctaagaaaagacatgtgaatagcctgacctcagagtcaccctggcctgagcttgccctcaacctgatctgaacttcctggcacttgggaccagaataatagcagtcacacctgagtttccagtataaggtcacaatgcaaagaagagaatcaaaaacactggtccgagaagatcttccaaatcccttcctaaatgaagtggttagatcagagatttatgtttgagtttttattctctcctgatttgttcacaattaacttgcaaagctgtgttaataggcagcttcatgaacagagatcccagaggttagagaccaataagaattgtacagtattgcatcatttccttgggaaattcttcaaattaagccactagctgcattcttttctggctcaatttagggtcaccaaaccatagaaaagaatgattcaccaaacaaacttttgcttttccttttctggtgcttcatttaaccgctttatgcctcagagtaaagctattataatggcattatccttctaatgaggaacagtgcaatgctttcctgatgttaatacccagaattatgcagtgtttaaaagccaccgtgactttagggaatactcactaagttttctattgcaaataccctagtcatattgaaaatgaatgagtgtaattcttttggtgtttttaaaaaacgtacaattcttttaataaatcatagttcccaaaaggaataagaatggttcattagcagtactaatgaaaattccatcttcagtaaaacttagcagaatatcattccctgtaacaaaatgttttcagacactttgtttgccaactttattaatggagaactttgtggtctagattagaaaactgaagataattgagagaaagagaaagaaagagaaaccatcctagacaagcagttatatgtatcatttaaaaaataatggctcaaacaatagtgtcacaaatcttcagaggtaatgagaaatttttaaaaaaattaaaaagtggcataaaaaacattgttcttagtaaaattcttttccaggcattatatttattgctgaggtgttctcttcatccactcgttcgtgtttagccaagcaaccttgagaagttcgaagttgtttgcctgctacagaccataaacaaagacggaagatttgaattttcaagtcccaaggcttcagctttgcaatttccttctcagacaaattttcctagagaaatagaatttgttttagttcctggctcatagtagttgcatcatacagattagtttactgaatgacctgatgaataaggcttttattaaagtagcagactaaacaatttttctgtctgtttttaggaactttccctgtctgtggaagtaagtgatgaccacctgaatgagaacagaggctatttatacagagcttgctatagcgagggagtgagcaccgtcacttgcatttggcagaggctcaaaggcaggcaagggagtaggaaagctttataattaaaagaagagaaaaggagatcctcaggtatggaaaagctggaggcaagataactagaagcaaggcattttgtatgattgatttagggagaatacttgcctttctctgattggccttgagttgaaagatggtaaaaattagtgaagctgggccgggcgtggtggcttacgcctgtaatcccagcactttgggaggccgaggcaggcggatcacgaggtcaggagatcgagaccatcctggctaacatggtgaaaccccgtctctactaaaaaatacaaaaaaaatagccgggcgtggtggcgggtgcctgtagtcccagctcctcgggaggctgaggcaggagaatggtgtgaacccgggaggcggagcctgcagtgatccgagatcgcgccactgcactccagcctgggcgacagagtgagactccgtctcaaaaaaaaaaaaaaaaaaatagggaagctggcagtcattgaccaagttctgattattttaggccaattactgcagtggttgttgtctgatttcctgggttgcttgctgcagaggttgtggatcacagagttctgttgtcatatatggtctggtgtgtattcagtctttcatcatatatagcaatttcttgaattactttctcatcccaatcccccttgacatttcaaaatgtagtggcacgcaaagtgacttgccaacttgtttaaatccattcgtttttgtttgtttgttttgagaaggagtctcgctatgtcgcccaggctggagtacagtggcgcaatagctcactgcaacctctgcctgccgggttcaagcaattctcatgcctcagcctcctgagtagctgggattgcaggtacctgccaccatgcccggttcatttttgtatttttagtagagacagggtttcacgatgttgaccacgctggtcttgaacacttgacctcaggtgatccacctgcctcagcctcccaaagtgctgggattacaggcgtgagccactgtgcctagcctaaatagtgattttacatggagttttgtcattaggaggaggaagaaacttgactttttcactctaaggggatcttctatttgtttccaggaattttagggactcacatacatattaaatttggaaaggttctgagaagtaattttaaaattgtctataggcagaaccacatttaaatcttcctagtgaggctgggtgcagtggctcatgcctccagacctggctaatttttgtatttttagtagagatggggttttatcatgttgaccaggctggtcttgaactcctgacctcaagtgatccacccacttcagtctcccaaagtgctgggattacaggcgtgagccgccatgtccagcctcaggttgaaagccttctcataatgtgtggtgacccttggttggctcctcctgttgaaagctgagctgattggaggctctgtgtatatttgagatatttgagaggctcattgattggtctgcattctttttttctgacagattctcactctgttgcccaggctggagtggagtggctcgatctcagctcactgcaacctccgcctcctgggtttaagtgattctcctgcctcagcttcctgagtagctgggactacaggcacccaccaccacgccctgctcatttttgtatttttagtggagatagggttgcaccatataggccaggctggtctcgaactcctgatctcaggtgatccgcccacctcagcctcccaaaagtgctgggattacaggccgtgcctggcctggtctgcattcttgaagggcaataaaatgaccagcttgacattttttttaagcagctttattgagatataactcacacaccatacaattcacccatttaaactgcacagttcattggctgttagtatattcacagaactgtgagtccaaaaccactgttaattttagaacatttttattaaaataaaaaaacctcattccttagccctcaccttccaaccccttccatcccatgctcctcaaccctaggcaacaactaatctactttttctctctacagatttgccttttctggatatgtcatctaaatggaatttgcagtatgtggtcttttgtaacttgcttcttttactcagcataatgttttcaaggttcactcatgtcatagcatgtatcagtacttcacttctttattttgctgaataatattatgttacatgggcgtaccaattttatttttccatttaccaattcatgggtatttgcgttgtttccactttctagctattacgaataatgttgtaatgaatatttgtgtatagacacgtgttttcagttgtctttggtgtatacctaggagtggaattgtcacatcctatggaaattacatgtccaagtgttcaaaaaactcccagactgttttccaaagtggatgcaccattttacagtcccagcagcagtgtatgggggttctgatttctccacatcctttgcagcacttgttatgatggtaacagctgtgtctttttgatcagagccatccttgtgggtgtgaagtctacctcactgtggtttttatttgcatttttctgatggcttaggctttcgttgtaagccttccaactatgagtatctactgatctttctgaggcaattccatttttctctctgaagggtactccagctatggctagcaggaagaaggaggtgggtgtgagggagttatctctgttcaatacacagattttcccttagtttcctgtactataatgcaccaccatcttcctctgagtctagtagttccaaatctaaaacttctcttattctccaataaatcaaattcttgccttttggaggagtgagggaagatggtcaccggtctgaatatgtgggagcctgggcatctaaattcctttttttttttttttttttttttttgagatggagtcttgctctgtcacccaggctggagtgcagtggcacaatctcagctgactgcaacctccgcctcccgggttcatgcgattctcctgcctcagcctcctgagtagctgggattacagacgggcaccaccatgcctggctaatttttgtagttttaatagagatgggtttcaccatgttggtaaggctggtctcaaactcctgacctcaagcaatccacctgccttgggctcccaaagtgttgggattacaggtgtgagccaccgcgcctagccactcttctttttattaaggatggaggaacaagtttctctttgttctaatatttttggagtgtttttccaagagaaaaaaagaatagagatacagctttattctgctcttttgaacccaagcttctccaaattattatggtagcatttcttattaaatatttacttctctcttattcttaaattgctttgttcatcttcattagtaattggtaaaggcccatcccttttaaatttttgactcattgtctcctactcccttcgagcttggctttgtttattcatgtggtaatttgcaagttgaaatgatatccaacttgggaaaattttgcaggatttttaaaaagcatatttggaaaagtttcttcaactgccgcccaatttatttataaaaggcagaagatgctttaatcacaaatatttaatctcagttgataaaattgtcttgggaagaaattaatttaatctaaagaaaatttaaatagaaagcaagatttaaatgattcattatcgttaccgttcttgtgagtgtaaaatagaagaaaataataaaggaatttagggttatacaacatgaggaataggaaaatgacagccctagtgagtgtcacttcccaaaaatgaaagactggcacacaggtctttgttttggaaggttgtggcagttttccatcctaaatgagattggtcactggacacagtccacatataattatgaagaatcttctggcttctccacttaccagaattctattcaggtcatatctcagaaatggaatacaaatgacttcctaaaattctaatagcatttcttcaaattccaattaagtttccaagtttatcttctctacctacataaggataatctgactgaagggccctggccaaagccttctgtgaacagacaatggtcattctcttggcagggggtggggtgaagaggttgtttcatgtaaggagattttagtataatcctgaggatttccatatgggatcctacggttctgtcaataccacaagttcttcaaaagcagaaaagcaaatttggttaaacttagaaacgtatctctagaaaagattactaatttctccttacccccagccccttctctctaaaagaaagatggatggttctggaaatgtcagtagctttctgccatcagggaaaagtcctctgataattgtgtgccgacgttgtctgggagctcttctggagcttactttacgtgcttctcaaacatggggatgggagttgatgggatctgagggcacttccagtttggatgtcccgtcatccagaaaacctctctcatacttaaggaaatgaaatgaaggagagaaggaagctacagggtattttaaatatatacctttgcattaaaaagaaacccaaaaaactccgaaacaaaaaaccaacccgtttagttataacataccaccagggtgcggatatgcatttcttcaaggccctatttccatcaaaactgtctccattgttaaaggcattcaaatatatgacaagtacactgtacaacagactagcccatgacttgtgccttattttatctgaatctcactcagcctctctcttttctctttcgcttagtctttctctatctctgtctctctctcacacacatatacaccactctgtgcccagtgttttttgttttgttttgtttaatttagaaaaggagccaagtagagaaaaagcagcatagattaatcgaagaaacaatgaactaatgttcagcccagctccagccagctgtggggtcctaaaccaagttatctcagtttcctcttcctctgtgctctcctttgcaaagtgggagaccataaccaacgagtttatcttatcggttgctgtggacctgcagtgagttaaatctgcctttgaacactgtatgagaggctataccactctccggatagaccagtttacacaggaggcagttattagtcctatgctgatttagtactccattataccacactccaggaatcttagggtggctcttccattaaaaagcattaattcagtgcctaactacctatcatggagatggtcaactgtccacattttaaagggaattggtttcaacctgtagcttttattctgttaagaattatctatgagaaagagatcagtcttggtaccaccaaaactgggtagaacgaattcttgatgtagactaaagggtgctaataccatttcagtattcagcagggactgaggtttcaacagcttagaactgtggtctcagaggtcacgtggttcaaccttatgtcctgggtatctaccaccctctgacacagaatccttgctggcttcattcagcaccttcctgattaaaaaaaaaaaaaaatttccactaccttgaggcagctctttggaattttggacagtttctgacaactcatgttaaggaaaaacttcctgtgtttgtccattggttgaattttcatccattgactgtacttgcccactgggtacacagaataagcctgtttgatgactgcagctccctggagacttctgtttttccaatgaaatggccctagattgtacagttgtttcctgattgctgtggttactctcttctttccacatgctggtttgttcagattcctttaaaagcgtgctgctaagcaatgccccctaggctctcatggaggtctgaccaatatgtccactttcaacatacttgacactgttcctcttcctgcagcctaagctggcataagcttttttgacagcattaaatcctttccttttagtgattgccttggcacaggcagcatgctgctaccctgctggagtgaaagcaaaagatgcagcggagtctggcaggacctggacaccttcatagatttataagctggggcctggatggaggagaagacaaagacagagatgtgaagctgcaaaggtggcttgggcaggatggttgggaagggaagggttggaacttagagacagtatctttgacattgactctctgacatttcaagaaaagaatgggaaatctgagcctttccccatggtctttgactccgaagccttttaagctcttcaaaaggcaagttaacttggagctggaaagtgaacagctttacctgctagtattttgttgaagtaacttcttctattcgtctatctaactatcgatagacagacagataggacagatatagatagatagatagatagatagatagatagatagatgatagatagatagatagatatagtgtgtgtgtatatatatatatatttaatgaggaagttggaaaattagatccaatattgtgtcctattcaatggcagctgctcactgcacaaagtaaggaaaactttgaggaaataaaagttgcttagaaaaatccagatgtcagggctgggtgcagtggctcacacctgtaatcccagcactttgggaggctgaggcgggtggatcacgaggtcaggagatcgagaccatcctggccaacatggtgaaaccccgtcactactaaaatacaaaaaattagctgggcgtggtggcacatgcctgtagtcccaacaacccaggaggctgaggcaggagaatagcttgaacccgggaggcagaggttgcagtgagccgagatcgtaccactgcactccagcctggcaacagagcaagactcggtctaaaaaaaaaaaaaaagaaaagaaaaatccagatgtcattgctttgtatgttgtgatgatgtggtagccagctccaagaagatggcctccagtgagtcttactttctggtattcatatccttgaggctgatctaagtaactgatcggatattatggagtatgctatggtctgaatgtttgtgtccttcttaaattaatacgttgaaatcttcaccttcaaagtgatcatattaagagatgaggcttttgggaggtgattaggtcttgaaagtggagctcttctaaatgggattagagcctttataaaagatgccagatagagcttgttagtcccttgcaccatgggaagatgtagcaagaaggctccattcatgaggaatggggctattaccagacactgaatctcttggtgttttttttttttttttttttttttttttttttttaagacagagtcttgctctgtcgcccaggctggagtgcagtggcgcgatctcggctcactgcaacctccgcctcccggattcaagcaattctctgtctcagcctcctgaatagttgattacaggtgcctgctaccatgcctggctaatttttatatttttagtagagacggggtttcacaatcttggccaggctggtcttgaactcctgacctcgtgatccacctgccttggcctcccaaagtgctggatattacaggcatgagccaccgcgcctggccattttttttttttaatttttattctcatgactgttagatcacatctgatggtgttttgatcttggactacttagtctctagagctgtaatacattcctgttgtttataaatcacccagtctaaggtattttgttatagcagcccaaacagactatgacagagtgtcacttttgagactaagtgatgaaaggcattgtggcttcttctgtctcgccatcttgaatcacttgctctgttggacgtcagccgctacgtcatgaagacactcaagcagccctatagaaaggtcttcatggtgagaaattgaagcctccgcccaatagccagcatcaacttactagctatgtgaatgatccatgctgaaagagcctcccgtagtccccctgaagccttcagatgactgcagccctggcaggcttcttgactgcaacatcataatgccctgagccaaaaccacccaactatgccgctcctgaattcctgacacacagaaactgagataatatttatcgctgtttaacttactaagctaataagttttaaacccttaagctttgaggaactttttttttatccagcaataagtaactaataaagatgggtagaaaggaggaatgaagagtaaagagactttattcattgttcatatatgttcatttgctaggcacttgctgccggcaccttaggctaagggtagaacaagtgctgggttcactgctgcttttgtacaccgctgacaaccaaatagggctgtcacacagaatgacaagaaaaaagacacgtcctctttcctccccttcctcctttttgcttttaggggaaggctaggatgacattgagaactcacacaaattttgtttttgactcctcagtgtcccctgggaaaaggtgcattggcctttgtgtacttgctacaaggctgtgtatccttgagagcaggacttggatcttatttatttctatccccgtttcctagcaagtgaacatatatgaacaataaatgttatcaagggagagggcaaatttccctccctgtttcttctgaattctgaagagattccattgttagaatggtttcttactgcaaccatcccattcacagtccatcagcgaagtcttgagagtatgatgcctgtcatgagccactttcactactaaataaattccgtccctctgttaagttcccggctgttaggacacctctgccttcagcaccgtttgacccttctatcccattttctctatgcaatgttgctttaactgttgttcaagatcccaggatgcttgatccgggaaagcacagaggtctgctgccaacataccaacatacctctctgtcaagttgtccaaaatcacaagagaaagagccctggactagagctaggagacctgagttctcggctgctctgttactgattagcgtctatgtccttggacaagttgcttccctttttccggacctcggttccttgtcctagataggttctaaagtcggtgggtccttacagtaagttaggattctaaggtgcaatccaaaagtaaaaccagtggtcagtatacctctgagtagctgttaaggttacaatacgaggttcctcggccttccctttggtagccaatggatacggcctcagtcagaggccgtcaggtttactgggaagagccttccggttttgaaagacaggatctccgggtttccagttctgtcactcactcggggtaactttgggcaaattctctctggacctcctaatagggaggtcctcgtcaccccgaggaagttcgaagacgtgggcagtgacttggaaagcttcccgagattccccttctataacctgggtggctcagaccgggagcggggtcccagccggccggtaattccgcccggaggtgcgcacgaaacaaacctgcagcgctggccgagggcggctcagcttcggagggcgcgactccgggtgagttcttaaagggaccgtcagagtttgggtaacacctgcgatgctgaccgggcggggacgcaggcttgagggaaatgaatgaatgaatgaatgagcgaatgaatgaacaaaccttctctgcccacccttaagtataccatactcggaattaatcagttaggcttaaaaatcttgtactataaccctcaaactcttgccaagttaaccagtgtctctatttcatatgtccttctgtaatgaaacccctccccccaagcctattactaagggacgaagagtaacttaacaatcagcctggagtggaaggcaatgcagagttggcacccctccccgaactcctccctctccctctcccaggccccgccctccccgccccctgggaggtgcagttggctcctccttaaggcggcttttccccggtggggatctacccccggggtcgccaggcgctgtctctgccgcggagttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtaaaggcgggctcctccagggccaccccgggccacctgtggagtccgagtgttaactcctttgttctcagagccacttcagcggccgcccttttaagcgaagaggttcccttaggatgctccccgggtaccccttccgttcccctgccctcccccgacccgcctcccccttccaacccgaaggtagcagcgcggggagcccggggctcggcgcgagccgcctcctcacttcccattggctgagagcgccgggaaagcggtcacgtgggagcgcggcaggccagctcgggggccgccatcttggcggaaagtttcgggggagagcggttgggggcgcggaaggaggcgaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcgccggaactttgtggcggcgccgcaggtgtgggggcccgcggaggtgtgcatgcggggcgcgagggcgtcgcggagagcggccgctgccctgtccggcccccgctggagcatcccggaggcagcgagcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaaggtgagagtttattccgtaactctgttgtcgatgtcacttgcttttccgtgtgtcagttttttgattgccgttttagaatcgtttgtgtaactttgatgagacagcacggtcctagctttattgcttagggaatctaagcctcatatcatttcagaagatggaaacacgaaaatgtttgttaaactttcttaacatttctctagtgattaagagaggcagttaggcccccccccaacagatgtccttaataaccctgaattggtgttttagtatttcactctatcattcttactaagcactattctgtgagcaactgtgggatactaagaatttgtattttgaaatgttaaaaatttggattatgatgacaaattgtagataatctgcttttgcatatcaggtaatctgaaactgttgctaatactttgatcttttactttggcaaactaccagtacacatttattccaaactgctcactctcctccgttttctaatgtgatatatgtttaaatttttcttgtatttctttaatttttttttttattttttggtcattctaaggaatatgtgtacatgaacatagtgacatcaattgacctgaaggatttgcggaactatttagatgtcatgcagaattatttgcactagtatgtgatactttttttgtaaatagagagttttaatcaggctctgctttttcttctcagatacccagagagcattgcaccttttggaggaatatcgttcaaaactaagccaaactgaagacagacagctcagaagttccatagaacgggttattaacatatttcagagcaacctctttcaggctttaataggtgggaattaaaacttcgtaactattatgccagctaggctttatgctcctctcaattcatttattttaaacttaagaaaatgatgtacttaattctctgaggcattcggtaacttgaacatcttcagtgagttgtgtgtttttcataggccagtgtcctttcttaaaataactagtaaccaaaaaactttcaggattatttcagtggcttttgagaacattgtttcacatcttaatagcattaactattaaaagatgttgcacagatgtttaaggacctaaaaggtatgactgagttactgtgagcttgtttctgtatttgactggcatgtctctgaagtcattgaaagcgtgtgaagggttctgctgtgttgaagaacattcattcccttaatgtagatttctgtttgagcttggcattcatggagtcagaattttagacctggaaaataatcttagagatgatcttgtctagtaaccgtattttacaggcaagaaaatggaaagttttattcttaattgtaacttaatttgaagtggtgcattgtttgaaagaactggaaaaataagagtcctgagttcttttgccactaattgaatgatatatcccaagtcatttaatcttttctatgccaccatattagctgtagaatgtagctgttgaaatgacagaatgggtttaaagccttttttaagtagataaatcatttttaaaagcatcatctcatattttgtgtataatctcctatgtataaaacaaggtgacttgtctggctcttttgtccaggtacctcaaaaagtttgcaaaccaccgaactagaaagtttgtctcttccaattctaagaatgaagttttttttttttgttttagttatcaactatataacattttaacataagaagacatatacttaattatattacatttatttcttcagtaacttccagtcagatatggccttacatctatctgttgatagaataattgttggtgtgatttgaagactactttcaagtcagtgtgtcctgtcaggtacattattgataaatggatgctctctacggttttagaatgaaagatttttgtaaagaccacttgatgcacctgaacaattttgaaaaatgtaacattttaatagacttttaaaaacataaggatacatagcacagtgtaatgaactgccttttaactgttacccagctccagaaattcacattttgccatttttgtttacattgatggacattttttacacatttgaatttctgaggtttaaggtccgaatggatgatcaaattggattcctctggaaaaacagcaaaaagcattttttagttatttgttttctaaatcaacattgagcctagtaatttggtgcagttactgttgcaaaaaaagtatgttttttcgcaacagtatagagatatatatatacatatatgtatagataggcagatagatagactgcagacttttctttgtgtgacggctgtaacttaagaaaattaaatcgttagtgaaataacagaatctacatttatatttctgtctagattggggatgggtttgctgtgttcagagacatttttgacctattctgccttgcctgttttgaatgtgtctattcttacgtacaattgaactttgatagagttagctttcttctctttttttttttttttttttttgaggcagagtctcactctgtcacccaggctggagtgcagtggcgagatctccgctcaccgcaagctccgcctgccaggttcacgccattctcctgcctcagcctcctgagtagctgggaccaaaggtgcccaccaccacgtccggctaattttttattttttgtattgtatttttagtaaagacggggtttcactgtgttagccaggatggtctcgatctcctgacctcgtgatccacccacctcggcctcccaaatgttgggattacaggcgtgagccaccgcgtctggcctagagttagcttcctaattactaagtttatatttgtgaatcttctaatttcattggttgtgaatttactttgacatttaaatttacttatatttaatgttctataggatgtggtactatatcacattttggtgtaagacaagtaatagattttaggagttttgaaatagataacgtttaatagaggttctgtgtgtttccatgctataattgttgatactacggaataaatacattctcttgtgtttcctgaataacttttaatacttagtctgaaaatgtttagtctgataagattttctttgtattttgcaactctaccattgttttgaaacagtgtcataaatgtactttaagcttgtaaattgccctaagctaaaccagttcattgtgtccatagtgtttgcagaaaaatccgactcagaagacagagtgccacttactgaaaggtttttttctctcagtaagtggcactctgtcttctgagttggtacctgtggaccactggattaaaggagagcaggggtcttggccacctgagctgtttggagtcattgagtgcttagatttttcacttccttaatttggaaatcacttgtttaggccgtagtgagttatctagttatctgtttggggtgccaagtgtctttggattttcagtctgcattgatcatttattgattgattctttgaactggtagtttatattgacttttcatgcatttaaagaagtttgagtgagtctctaggggtttggtgtccccccctgtagttgatacatagattaggttcctgtacttttggattattcagagggacaagcatgtacgtactgtattatatttgttctaaaataccaactgttaaatatttcaatatctggtatatgtcatttttaattgacagtgtttctgtgttctgacacatgaaatagtgcattttataattgatactcgcaatgtaatatagaaatcattggtctagtgctgatagatacttggtagtatctttgaaggatggcttaaagatttaaaaatccttgaaagcagaaaagtttttactaattttgaatttcagctgatgtattgtttctttagagctaaatatttaaagttgtatcttaacaaaagtccatgaactgcacatttgtttaaaatttactcccaaaacatacctggtgattatttttgtataaaggaagataaagtctgcttaatttcactctgtgatttaggtgagagcaatttgaaaacttgcttttgtattccagttttttgtgcttaagtttgaaaattttttgagtagatgggatatggtttgattataatcagagcccaggtattcaggtccatagtggtttcagttcattcatgattctaaggtgtgtgggatctgaggtgacactgctagtccatagagacttcataccagtctaaacccctgcagttatttcttacgggatcagagaactcatctgctttccttgtgcatgagaaaaattggggcccaagattaggctggctttagagacttgagtaagttgagtcatgtgatttgtatattttgtctgcaataaataagcttattctaatgcagtgttttatttctgcagagatttcagaatgaaagtggattatgtaataatactgtccatttatgagtttagttaccagttcatttgttgccactctattaaaatctaatagtttcactagcccttataaaaggacattaccctatctttatttgtagatactagtttcaaaagtatgacccctttgccatcttcaccatctttaaatgtacagttcaggagtgtgaaatgtattcatattgttgtgaaacaaatcttcagaacactttcgtcttgcaaaactgaaatcctataccgaataaacaactgctcccctttcctctcacttcccagccccttgtgaccaacgtgctgctttctgtttcagtgaatttgatcatgttagaaacctcatagaagtatttgtctttttgcgactggcttatttcactcagtgtagagtccgcaaggttcattcatgttgtagttgttgacaggattttcttcctttttcaggctgaataatattccgttgtatgtatataccgcattttatctagccatccattgatggacagttgggttgcttcctcctcctggctgttgtgaataatgctgttaggaatgtgagtgtgcaaatatttcttcaagaccctgctttcagttcttttggatatttacccagaaataggattgtgggatcatacggcagttacatttttaattttttgagggcccaccataatgttttccatagtgattgcagcattttacagtctcaccagcagcacacaggatttccagtttctccacatccttgccgatacttaatttttttcctttctttttttgataatagccatcctaataagtgtgagtatatgactcctcttcaagtgtatgtaaaacataataaccaacatttattgagcactttctatgtgctaatacaaatatatcatttagtcattgtaatcctgtgaggtgtacattcacctgtatgaggtgtttgtactgttttatagactggaaaactgaagcactgagaaatgaccaatcttgcccttggaccctcagatgctaaattgcggagccagaaattgaactcaactaatctgaatccatagatacttctcaccgtcaaccattgggatattctttatcgttgtttttcagaactgagtattttaatctgataaagaattctaaatgacaagcatgcttaagacagatagcaatctttagggttagtaatctttaaatgattgtcactttgaaggaaaatatttataatggtgcattatgtttatgatgatggaaatcacacattttgaaaacagtgtttagtaatcagggtttgagatcttccagctatagtggtaaaatgtcaaaatttcttaaatttcttttgcattatattagtcccactgatgttacattttagtctcttgctaactgtgtgtgtgtgtgtgtgtgtgtgtgtgtgtgtgtgtgtgtaactttgtaggctagatttgagtaaggaaaacaggatatggatcacgtcgttggctgaaacttcctgaaatggaaggagaattttagtaacttctcacttgatggttttgattcaattagattgagttctttgctcatagtttgcttactactgctctgaagcagtgttttgattatgttgaatctggctgaattctctttagaaccttggaatcagagttgtaaaggcatctaaatatttcttctaagccatttcctctctgcagggtcatatttttcctcagtgcagaatccagacttggaccagatattaccgttagttgtcacgtctctttacttagggcacatttccacagcttttctttgtcttgtgtgagactgactttttttttttttttttttttttactatttggagacagggtcttgctctgccacccaggctggagtgcagtggtggcttactgcaacctctgcttcccaggctcaagcaatcctcctgcctcaggctcctgagtagctgggactacaggtgtgagcccccacgcctggctaactttttctagagacaggtgttgcccaggctggtctcgaactcctgagcaaagttctgggattacaggtgtgagccactgcgcccagctgagattgatgattttgaaaaacgcagttccttccactcttacttttttttaatataattttctcattttgggtttgtctgatgtttccttgtgattagattcaggttttgtattcctggcttaggattctgtacatccagaggtacacagagtcatctgctctttgttgatgatactgattttgattacctagttgggtgttgtctgaattctgtatcctatagtcattgttttttaccccttgtggcttataggcaatatgtgggggagacactttaacaccatgtacatatcctactccttagcaaaatttccacccatatttagcatccattgatgattcttgaaccgatttataatatggttgttgaaaagtaagatttctaacagtaacactcctaggtttaccagttaacactttgcattttattctaaacaagagccttccttctttttttcccgtgtctttcatgaacttgcagatacctgtttttttttcaatgacttatcatttattaccatccttaatgacatttgtgctctgagtgatccagtgggggccctttcaagcttgtgtccttatgagatgccctcatcattttttggagcactttcttaatttttggcataacaagatgttccaggtttatcttgtacctctcctgccccagccctggaatcagccatttctctgagaagctctggttccttttagtacacaccttgttttacggaatatgcttgtgagtcatgtatgattcttagtctaatagtatctaaagtattcaagtaatttatttttgcctactagcttgacatctttcctttctttagtgtgtgaaacaatagtacaaacttttaaattttataggatattctttcttctaggggtcaaaaatgactttttaaatgaacattggtttagaagaaagagtatttgtgcttgagtagatttgactattgtagtattatcttagtatgtcatctgcccttcactgatgatgttaattttgattactcaattgggtattgtctgaataatcatacttgcttttagtaaatgaactgatagaatttttttcctctgaaatggtagggttatatttcagtgttcttcagctttctagttgcctttcctgtaaccctccaaaataaatttattataaaaatgatgcatgttctatataaaacatttgagatcagattattatatgtaaaataccataagaaaatattcacaccagaggttacctcctacttcatccatgggatgaatatcctggaatgttatttgtgtgtgtgtgtgtgtgtgtgtgtgtgtgtatgcgcgtgtatacacgccaccccccaccttcattttgcaaaacaaacttctaagtaaaacagttatttcccttgtgagaattgatacttaaaatcagcatgtaaggtgaaaaacctcatctagttaaaattatccctgaaaagccttcagaaatttaacactagctcttgttaattacagcacaattgttttttttcctctagtggaaaggaatgatttcttcacttgagccctagacgaagcaactggcttgtttgacttcttgtactaaaaacacgtaattatagaatcacactcagcacagtgagatatagcaagaagctcacattttgagaggcacatgaaaactcagactacctaaaggaagaatcttcttccttctcatttttttatttgtgacagtcacttattgggtagacagagttgcccttttttgcaggggagatatactgcagttgtatttgtataagtgtgaatagtatgatttctctgtactatacatattgtttttatcttctaaagtttatcgacaaatgtctttccatgtcagtagatttgtaccattttatgtatgtatgtatgtatgtatgtatgtatgtatgtatgtatttttttttttttttttttttttgagacagtttcactcttgttgcccaggctggagtgcaatggcttgatctcagctcaccacaacctccgcctcctaggttcaagcgattctcctgcctcagcctcctgaatagctgggattacaggcatgtgccaccacgcctggctaattttgtatttttaatacagacagggtttcttcatgttggtcaggttggtctcgaacccctgacctcaggtgatccgcccgcctcagcctctcgaagtgctgggattacatgcatgaaccactgtgcctggccagattcgtaccattttaagtgactgtgtatatagattttttttttccttttcttttcttttttttttttttttttttgagacggagtcttgatctgtcaccaggctggagtgtagtggtgcaatctcggctcactgctacctctgcctcctgggttcaagtgattctcctgcctcagcctcctgagtagctgggattacaggcgtgcgccaccacgcctagctagtttttgcatttttagtagagacagggtttcaccatgttggccaggatggtctcgatctcttgacctcctgatctgcctgcttcaggctcccaaagtgctgggattacaggtgtgagccactgcacccggcctatatagattttctgtagtttttttaatggtttcctaggagcatttaggtttgtaatttttgtgaattataaatattgtatttgcatatgcatttttgtttcaattctttactatattcttaggacaaactcctagaaatgaattgtttggtcaaagggagtgtgcattttaaggctattgaggtaatttgttaaatactcttaggaatgttgtatttattttttaggaagtatgtggaagaatgaccaattcaccataccttaagcaatacagagtgttatccatcttttaaatattttctactctgatatatggaatatacctttagtcatttttctgttttattgtgcattttgttgattaaagaaatatccaaagctgtaagaaagtctttaattattttaatttcttttgtaaattatctgtttaatttgtgccccttcctcctcctttttcctttttcttagaggtataaaatctacattaggcctgtcaactctgccgtgtaaattgcaaataacttcccgtgttacttgcttttaaacttggcttttaaagaaaacatatatatatatggttgggtttatcaatatttttctttatcaatatactgctttctgcccttaataacacgtttggaaacattcccaatgctctaagccccaacattattataatctattgccaagattgtaaaaacctgtattcaaattctttcaagactttaacattttaatgcatttgaaaattatcttgatataaagtatgagattgccttttaatataagtttatttatctctcatgcagtttaagaaattaatagatttttttcagcagttttgaatttacagaagaattgagtggaaagtacagttcccatatcccaaagccccacttcccttttccatcttgtaggccatgtgtggtggctcaacgcatgtaatcccaacattttgggaggccagggtgggaggatccttgagcccaggagtttgagaccagcctgggcaacatagtaagaccctgtcttaggaaaaaaaaaaatttaaccaggcatggtggcatgcacctgtcgtcccagctgcttgggagcctgaggtaggaggatttgttgagcccaagaggtgaaggcgctactgtactgcagcttgagtgacagagtgagactctgtctctttaaaaaaaaaaaaggcctgagctcaggtggctcttgtatataatcccagcacttgaggaggccaaggtggtggaattgctggagccagggagataacagctgcaatgagcatgatcataccattgcactccagcctgagtgaccctgtctcaaaaacaaaccttgcattagtgtggtatatttgttaaaattgataagccaatattaatatattgtcattagctaaagcccatactttacattagtagtcactctttgcattgtacattgacaaatctgatgtgcacattttttgctttgacacgtatccactattgccgtattgtacagcaggggtccccaactcccgtgccacagacctgtacctgagcggcaggcgagcgattgccacctgagctctgcctcccgtcaggtcagtagcggcgttacattctcacaggagcatgaaccctgtcgtgaactgcgcgtgcaagggatctagattgtgcactccttatgagagaatctaatgcctgatgatctgaggtggaacagtttcactgcagaagctcccccaccctcttttctgtggaaaaattgtcttccataaaaccggtctttggtgccaaaaaggttggagaccgctgttgtttttcaccaccctaaaaatcctgtgtgctcttcttcttctccggtaccccacttctacaccccccacacaaactcctgaaaaccactgatctttttactgtctccatagttttgccttttccagaatgtcataattggaatcataagtatgtaacctttttagattggcttttttcagttagtaatatatttacggttcctccatgccttttcatacctaatagctcgtatctttttatgactgaataatattccattgtgtggacatactacagtttatctactcacctgttaaagaacatattggttgcttcaaagttttatcagttagtataaagctactgtgagcgtttgtgtgcagggtcttgagttgacttaagttttcagcttgtttgggtgaataccaaggagcgcaattgctggagcatatatagtatgagtatgtatagtttttaagaaatgccaaaagtgccttccaaagtggttgtaccattttgcattcctgtcagcaatgtgttgccctgtgtcctcaccagcatttggtagtgttggtgctttggattttagccattttaataggtgtgtagtagtatcttgttttaatttgaaattccctggtgatatttgatatatgctcacttgccatctctgtctttggtgaagtgtctgtctgtatcttttgcctatttttttattggattgtcttcttattgttgagtcttaaagaattttttgtccacttgaatattagtcctttattgggtatgtgttttgccagtattttctccctgtctgtggcttatcttttcattctcttttccccatcaaataaaattattatcttctcatagattagaaatgtcaccggtattatgttaaattattacatactcttgggcctgtatttagattttctcccctgaccctaagttagtattgccttatttctttagtttgagaaatgtttcttggcttgtgggtttctctgtttaagattatgtaagttgtcaccaaaagctagaatgtttctttgcctatttgaaagttccctttctcccattcctcaccccctttgagagtatttctgggattctgcactttccctttactcccattgtttgcaaactttgaattctagcaagaaaataacaaaggtaatgaaaaatttttatgtaaaagaaaatgatatatttgaaggcttctgaaatgtgtgatcttggagatttccagttgtttttttttttttttaatagataagaatgattctggcctcttctgttggacctaactgcttttcttcaagtttgatttttggaggtttcttagtgtacatgttagagctttgtgtggtcttgtttagatctgcgttcaggaatcggacttgtggaaacccagtttaggccaaaacagggaaagcacttgcagattatgaatggaaaatgaggaatagactgtgataagattgaccgagtaggtttcaacaaaattaatgttttcagttgtgagtcaaccaaaatctaattttttcctaatacatattttagtatttctgcattttcttgttttctcttcttgcttgctgtagtgtatcattattttcaaagaaaataatttttcgcagggtagtaaataaaaatgtaataggtgatttcaattctttggtatttggtaagctttctggatcttcagatgaatatagaatcacttgtagctattggcagtctcttgactacccctctgtgctcccattttctttacattttcatggtgaagatttaagtttagagttgtactcaagttaaatttttgcataggtttattgaaagactatcattttatactaggtagtaaatttggcaattcctgataaaatagtattgagagagatgacttttgaagcattattttgctatagttggattttgttttacatagtgtgatgtgtgtgtgtttgcgtgtatgcatagcacatatgtgtgtgtgcgtatgtgtgtatataatattcttaacaccctgtgaggtaggttaatattatcctcactgtacaagtgttagtttttaccagccctttacttggaaagttttgcaattccactggttattaaaactgaaagggggctgggtgcagtggctcacacctgtaatcccagcactttgggagcctgaagcgggcagatcacctgaggtcaggagttcgagacctgcctggccaacatggtgaaaccctgtctctactaaaagtacaaaaattagccaggcatggtggcacgtgcctgaagtcccagctactcggaggctgagtcaggagaatcgcatgaacccaggaggtggaggttgccgtgagccaagatcataccactgcactccagcctgggcgacagagcgagactctgtctcaaaaaaaaaaaaaaaaaaaacaacccaactgaaaagggagttaagtttgtctctattttgtgaagtttgtttttaaaaggactaatgcttttaaaataatgagaagcaagaagtctaagttattctgtctaaatgttgcttacagttatgaattattctatacagggtaatgcccacttttactattcccttatccaaaattatacaagttggtgaataaggaattaagcgtggtgaatctaagcgttatataactgctacttacagcttcggaatagcgggaataattagtgttaataagtttttataattctagctgattgcaaagtcatttgatcttttaaattatcctgtgctattataaataaatttatcatttattttagagttttgtcatgactttaactgattgtttctaaagtagtataaaatatttaatttactattataaaatattcagactagaggatatccgaaagcccttctagttctttgattttaatttcctctttttttttggctttggctttggctagaagggcaattaaaaccacttgagggatttacattcccagcttagatattggtggtgaacggtaataactcctatctgtagaattcacagtaatgatattagctaccatctgttaggagcctattctgtgctatagtgctaggcatcttatatgtattatacttgagccttgaaacaattcacagtgctaagaggcaagttaccagaggttaagtagtttgcctgaacttgtagctagttggtgatggagttgggatttgaatcaagtgctgactttgaagtgtaaaaagcctatgaattttacactgtgccctgcaggttctgatatgattgtgatataatgaaataagataatattcactgtttaagtacattatacgatgggaattgatttactaatctagagtaaaaattgtgcttttgagttatgttgttatagcattgcataatttagttagaaaatataaatacttatgaatttttattttccttcttctagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttctttattttattaaaataatattttatacaagtggattttgttatggaagtataatttataatagaataaagagaatggggttaaaaatatttttgaaaagcaaagctcagattctctgttgcccctgttttaaaatgttatgaatgtttgaagtctgaaatacttgatttagactattaaaaaattctttgcatgatagacctcaacaaggcttcatctgtgtggtaattaaaatggaaatggtactttgaaaagatggttttgctctggtattctttcctagaaataggatatagttttgtggtctgggctgctaagttgtacccatttacctcaaggaatctcttctttattggcttgaaggatggcattcaaactcactagagactgaagagtaaacctgaacatcagcactggtttctacattttctgtaaagttatttctttgagtattcataactatcttagtaatatacttttttgtgtgtgttatactgttgcccagttggatatggtatagcagaggtatgaagcagtttgtaacaaagattctgcctaagaagcattagtcatttgaaagtggttatttgtctgaatttgaatctagtcctttctagttagtgtaagatggtgctgtgcctggaaaatgcgatgtttctgtttggtgaataataaatcagggaaaagtggtggtaggcctcaaccagatagcactttggtaaagaagttagatggcttctcagttttaagtaacagaactatagaattttagagcaggaagaatcagagcacatctgatcccttgtcttcatgttaaagatgaggaaactgagatccataatagaataacttgacccactttatttagctagtttgggcaattatacctttgaatttcaggactcttaacacccaactcacagttctctttattaatcctagaccttgtatgtttctttttgattagtgtaatgtttattgtgtatatccttattttctttacactttttttccatcactttttccaggataatttccatttccatactctttgggttaatacatcacttgcttttataatagtctgaggtctatttcaaatggatttttaaaatgtcttcagtcagtcactgctgtggtttgaatgtgtcccctccaaaattcaggtgttgccaatgtgaagataatgagaggtgggacctttaggaggtgattaggccatgaggactcctccatccttcatgggattaaggcccttataaaagagcctccacagcttgggcacggtggctcatgtttataatcccagcactttgggaggccaaggcgggtggattgcttgaggtcaggagtttgagaccagcctggccaacatggtgaaaccacgtctcacgtctaaaatacaaaaattagctgagcatggtgtcatgcacctgtaatcccagctaccagggaggctgaggcaggagaattgcttgaacccgggaggcggaggttgcagcgagctgagacggcatcactgcactccagtctgggcaacaagcgagactggtgataagcgagactccgtctcaaaaaaaaaaaaaaagagcctccacaaaaagtttagcatgttagcttaactttttgctttctgccatgttgagatgtaacaagaaggcccttaccagatcagatacctggatcttggacttcccagcctccagaattgtgagaaattattttctgtttttcataaattacccagtctcaggtatgcagctgtagcaacacagaagggactaagacagttatttcacatttattgtcttagttctaggttagaaaattgcttatgtaaaaaacatgttaaactttaagagaattgaattgcttactagtattttttattgtccgatttatgatacccttgattataaagcctcgaattcttatactcgatttacttatttttataggcgattgtttaagtaatgtaaccattgaaagtgaatatttgacattattggtggaaatgtaaattattacagccattatggaaaacagtatgcaggtttctcaaaaaaactaaaaatagaactgcccaccagcaatcccattagtgggtatctgtccaagagaaaggatatcagaatatcaaagggatacctgcacccccatgtttattgcagcactattcacagtggccaagatatcaaatcaatctaaatatctatcaacaggtgaatggataaagtgtgatacacacacacacacacacacacacacaaaatggactactattcagccataaaaagaatgaaatcctgtcatttgcagcaacatggatggaactggaggtcattatgtgaaattaagccaggcacagaaagataaatatcacatgttctcatgtgggagctaaaaatgttgatctcatggaggtaaagagtagaatgatagttaccagagactgggaagggtgggagagggaaaagatgaagagaggatggttaatgagttcaaaaatagttagaaggaatacattctactgttcagtagcacagtagggtgactaccgttaacaacaatttattgtctatttcagaatggtttagaagatttgaaatgttcccaacacaaataaatgataaatgtttgaggtgatggatattctaaataccctgatttgaccattacacattgtatgcacgtaccaaatatcgcatgtaccctataaatacataccattatatatcaataataatatttttaactgtaagtattctttaagattgaaaaagtggacagttttgtaagctgaaagtttttttccatatagatttcattcaggaagatcagtagtgcattgaatttcatcaaaaatggcattggtaacacttcaatttttataaaatgatgaggcactcatatctagaacgctatttgcagctctggtttctacacctcctgaaagatatattatgaacatggtaaaggcacctcaagggaataggagaaaaagaactttcatattgtgagcgtcagatcttattagtttggaaagtagatgagaagagaatatggtcacagagtgtgtttagcgcatggcacatggaaaatgctgtagtaatgtttgaaatctgttcatattcatgaatagactctaaggggaacattgggatatgtccatcaaggcctagatgtttaaaaagtagcaaaaacctgtatatatcaaactggagtgagcaaagtcagttagtaggaagtaccatcttatagagatgacagaaaatcctgacaaatgtttgtctgaaaatgtaaatagttttgaaacacactgatggatgatatttataatgattttttaaaaaacctggaatgtttggggatttaattgctactttttgaaggtgctatgagagaaagtaagcatgttccctttcacccatccattcatgcttcatttggaaaacttggctaagtgatcatttgatctcttgtttcatttgctactttagactcttggggcatgatgtttaggactaaaaagggacttagagaatccacttgctcaaaacaaataacttacaacttaaagtttattgtactataacttgaaaaatttgaaaatcaaaaccattttgtcttaaacagaatttaggttatacttgtgtactaattcttggatatagtaatcttttccaacaaaattgcatgcaacatgcctctttgacttcatgtttgcttttgcaggactaaaaagaggattatttttgctaaaagtagttaagattgctcaattttcagaaagccttgactgttattctcttaaaatgcaaatcttcatctttaaagcagctatccagttttgtcttttttttttttaagttcactgatctaattcttgccaggtcatttgtcagttactttgtgaccttataactttgtttgttctatttcttctgatgtagtaaatttaaagggacaggattagtatcccattttcttaaaaaaattttttttgtatatattatcttttactttgagcatatgtctagtgagatgtttggaataatgtttgtttagtgtttaatgattgtttcagagtgatagggatttttttcttttttgtactactttttttgtttttttagaaactgtgtctcactctgtcacccaggctgaagtgcagtggtgcgatcatagctcactgtatcctcaaaacttgggggctccagggatcatcctgcctcagcctactgagtagctgggcctacatgtgtgtaccaccacacccagctaaaatcatttcttttttttttttttttttttttttttttgggacagagtcttgctctcccaccgaggctagagtgcagtggtacgatctcgtctcactgcaacctccacctcccaggttcaggtgattcttccacctcagcctcccgagtagctgggattacagcacccaccatcatacacggctaatttttgtatttttgtagagatggggtttcaccatgttggccaggctggtctcaaactcttgacctcaggtgatccacctgccttggcctcccaaagtgctgggattacaggcttcagccaccatgcccgaccccaaaaccatttctttaaacagttttttgaagactgggtctcactatgttgcctaggctagtctcagactcctggtggtggtctccagcagtcctcccacctcagcctccagagtagctgggattacaggtgtaaggtaccacacccggctctctctcttaattttaaaaaataacacgtcatttttataagaacaactctattctaaaataagagtgagttagttttagagattataagaaaggatatagacttaaaaaaaagcaagagtaaagagtaggaggaattgcctgatttaatgggatatttcagtagaaaagggttgatttataaggaaggatagatgactcttaaaaagatgaggccaggcctggtggttcacacctgtaatcctagcacttttggaggcccaggcaggtgaatcacctgaggtcaggagttcaagaccagcctgagcaacatggcaaaaccccgcctctactaaaaatacaaaaattagccaggtgtggtggtgcgtgcctgtggttccagctgcttgggaggcagagacgtgagaatcgcatgaacctaggaagcggaggttgccaaagaacccaggaaggcaagatcgtaccactgcactccagcctgggtgacagggtgagactccctctggaaaaaaaggcaagatgaaagagtaggaggaatttcctgatttaatgggacatttcagtagaaaaggatgcaccctactcctaacatcacaatacatttcaactagactagagattcaaaggttaaaaaaaaaaaaaccataaaagtaagattttggggctgggcgcagtggctcatgcctgtaattccagcactttgggaggccaagctgggcagatcgcttaagctcagaagttcgaaaccagcctgggaaacatggtgaaactccatctctacaaaaaatgcaaaaattagctgggtgtagtggctccctcctgtggtcccagctactcaggaggctgaggtgggaagatcgcttgagtcctggaggtcaaggctggagtgagccaagatcgtaccaccgcactccagcctgggcgacagagcgagaccctgtctccaaacaagaaaaaaaaagttaaaaattaaaaaaaataaaaattttgatttttaataaggaaggcttttctaaccatgaccaaaaaacaccacaaaaattaaaaggttaaaaatgctgctgactttatagaatttctttgtggactttgacttcaaattttgattgtagaacttctgaatcttgaaagatataatacaaagataaattatatattaggatgaaaatttgtcacatatatgaaaaaggattaattttaatttccagtcctttcaacctaagaaacttcttatagaaactaagaaaaaggcccgtgttcaataggaaactgacttaacagtgtgagtattgtagtttgaagaagaagaaataaatgtgggccaataagcctatgaagaaatgctcagccacacttaaaaatgcaaattacattgacagcaaggatatttttaacaaatttgattgtcagagattaaataaataggaggaaacagaagctcctgtacagttagtaagggagaatacagtagtgcaactaatttgaaagacaactttatattcgtatcgtttgatccagcatatgctccagattcaccacagattattgaaggtatttgtacagggatgctcactgcagccttaattagtagaaaccaacaagggatataaaagattatcggtaagagatcggataaacacattatggtagagccatttaatgcaagataaagtagcaggcaaaatatattctgtgtatccattatgtgttattaaatgagtgaaagcaggttacatgtcaggaggcatagtatgactttgtgtgaaaagaaaaccatgaggttaggcatgtctggaagaatatacacatagtctgctttcaatagtactcttttaaaattgataaataattatacatatttatatggtgcttgtggtattttgatacatgcataccatgtttaatgatcaaatcagggtaattgggatatccatcatctcaagcatttatcatttctttgtgttgagaatattccagattttctcttctagctattttgaaatatacaataaattgttgttacctatagtcacctactgtgctattgaacacttctaattgtatttttgtacccattaaccaacttgtcttcctcccctccttcactgtacccttctcagcctctgataaactaccattctactctccaactccatgggatcagctttttagcttccacatatgagtgacaacatgtgatatttgcctttctttgtctggcttatttctcataagatatccttcaggctcatccatgatgctgcagatgacaggacttcatgctgtgttatggctaaataatattctattgtctatatatgctacattttatttatctattcgtctgttgagggacacttaggctaattccctatcgtggcagtggtgaatagtggtgcgataaacatgggcatgtagatctctctttgatatactggtttgttttcttttgggtgtatacctcgcagtgagagtgctggattaaatggtggttgagaaatgaccatgctgttttccgtaatagctgtactaatttatattcccatcagcagtgtaccagagtgtccctttctttacatccgtagccagaatctgttatttatggtctttttgataatagccatattaagtggggtaagagaatatcttttttctttttttttttttttttgagacagagtcttgctctgtcgcccaggctggggtgcagtggcgtgatctttgctcactgcaagctccacctcccaggtccaagcaattcttctgcctcagccacctgagtagctgggactacaagtgtgctctgccatgcccggctaattttttaaatatttttagtagacacagggtttcactatgctggctgagctggtcttgaagtcctgacctcgtgatctgcctgcctcggcctcccatgtgctgggattacaggcgtgagccaccgtgcccagcttattatggttttgatttccatttccctgagtattattagtaatgttgaacattttttcatataccaattaaccatttgtatgtcttctgagaaatgtctaatctgatcatttgtgcatttcaaaatcagatacttgcttttttgttgctccttatatattctggttattaatacttgtcagataaattgcagatattttctcccattctgtaagttgtttcatcactctgttggtcgtttcctttgctgtacaggatctttttagctcgatgttatctcatttacctatttttgcttttgttgcctgtgcttttgaagcattacctaaaaaaatttgccctgaccaacatcctgaagcatttccccaatgttttcgtatcgtatcgtgtcgtgtcgtgtcgtgtcgtattgtatcttttcaggtcttagatttaagtctttaatctattttgatttgttttttgttacgttttcatattgtgagtaatgggagtctagattcattctacatatggatatccagattttcccagcaccatttatcgaagagactgtccttttcccattgtgtgtttttggcttctttttcaaaaatgagttggcttaaatgtgtggatttatttctgtgttctctgttgtgttccgttggtctgtgtgtgtttttacatcagtaccatgctcacttggtgactgtagctttgtagtaggtcaggtaatgtgatgcctccagttttattatttctgctcaggattgttctgggtattcggagtgttttatgattgtatatgaattttaggcttgttttttctatttctatgaagaatgtcactggtattttattagggattgcattgaatctgtatattgctttggttagtatggacattttaacaatattagtttttccaatctatgaacatgggatatctttccattttttttgtgtcctcttcactttgtcttaggagtgttctagagttttcattgttgagatcttttactactttggttaaatttattcctaggtttgttttggttttttttttttttttttttttttggtagctattataaatgtgattgtattcctgatttcttttttggattgtttggtgttggtctatagaaatactactgatttttttatgttaatttttgcatacagctttttaaaagttgtgcctgttatttacaagtcccccctttcagcccttcagtgtttatcttattgggaggggagttttctgactgaatggtgttaagggatacttttccctttctctttgaccttgtggtttaatattttaaaataagccatctgctttaatttgagtggagttttaggaggcagtagagttaaaagtatatattcagccgggtgcggtggctcacgcctgtaatcccagcactttgggaggcagaggcgggcagatcacttgaggtcaggagttcgaaaccagcctggccaacatggtgaaaccccatctctgctaaaaatacaaaaattagccggttgttgtggcgggcacctgtaatcccagctacttgggaggctgaggcaggaggcctgggaagcagaggttgcagtgagccgagatcacatcactgtcttccagcctggctggcagagcaagacactgtctcaaaaaaaaataaaaataaaaataaagaaaaaaatatatatatatacacacacatacacacacacacacacacacacatatattcagtgtaccaggtttaatctgaagtcctctaaacattgacaaaaaatttactgaaatactgtataatattcttacataaagatacacaaataataaaggaataggttgattaattactgcattgtgaatataccaggtcaagaaaaagaacatggaatgactgctaacaggttctggaattagatagtgatggtagttgtacaagtctatgaaaatatcaaaaatcactgaattgtacactttaaaatttggtgaattttatagcatgtccattttatctcagtttaaaaaagaaaaataccagtaccccagaagtcttccttgtactctccctatttactacctatcccctcttcctcagaggaccatccaaatttccaacatcatagattagttttgcgttcttttaaattgcatataaagagacttacacagtgtatatacccccttgtgtgcttcttttttcttatatttgtgcatttcatctatgtaggtaaagttttttcatccttactgttgtatgatattccattgtatgatataccagaatatatttacacattctgccattgatggtcatgtggattgtttccagttttgattagtgttgcattgaacattcttttacattcaggtctgctgtaacaacagataactttcctaaaaatcaccacactatgaaaaatggcacaatgaaaaccacaggtgttatttcaaaaatgagggcagggaccaaacacttaaaactttgtgagtgacatattaaaagagattaaaacctaataaaaacaacagcacagttttatgcttttttttttcttttttttttccttagaggaggtcttgctttgttcttcaggctagtgtgaggtggtgtgatcatagctgactgcacccttgaactaacgggctcaagctatcctctgcctcagcctcccaagtagctgagtttataggcgtgagccactgtgcccagtttatgcatgttaagtggtgaataaatatgtgaatactacaatcaatttggcatcttaccttggaaaaaaactcagctttgcttataggagtgtgttgcaaagagttgcagcttgtgagttactgtgatgtgttagctgggggagctatctgaaattggatgagaacttatagtagcaccagttgtagaggagtgtggatcataaaactcccataaactaaagtcgctggtagatgtctgaggtgtgtgcattttgtgtattcttaggtggctcgtatcctctgggtacagttttttgccttcacctagtctttctcacagacaagattgtgcttgcttttcctgtatgtgtgtattttttggaactatttgaaaatcagtcgtagacatcatgcacttaaactattaaaacttcagcacgcatctcgtaagagtaagaatagttagatattcttctgtgttatcttagtaccattaccacatctgagaaaattagcaataattgttcagttttctctccaatctctattcaaaattgtccccagtctattttgtgggacttgaaaaaaatcagataaagcagataaatcaaatacataccatttatgcatttgattgttaggtgtcagtacacatgccatttatgcatttgattgttaggtgtctgtttttaactgggttttcctaaaagcagaacctgaggcagagggcttaggtgctattaatttatttagagagttcattcctagagagcagaagtgagggaaagtgtgaagatagtataggaaggggaaaaactaatacaaggatgcttcctgccactaagtgtgactgatttttgtatccttggtattgcatccctgagaagccatttgtactgcatgttaggactctgcaaggaaagagaaagaatttatctactggcttctagtgggcagcagttcccccatactttagggttgtggatttgtcagtgtaggtgatttatcaggaaagccccaagtgagggggtgagaggaggagatgtggactgggggccacaggcatgaagtgttcctggggctgctcaggatgaaaggtaggtgtgaagatctgggggtgactgttggaatgggttgggaatacacataccaaatctggtacagtgtctctagtcttttgtaatctgatagaatagtcttccttatcttcttttccccccctttaaatgacattacctttttgaagagaccatgccagttgttttatagactatcacacattctttatttgtctcatttgtttccttatgttatttaactcattccactaatccttgtatttctggtaagaggaagttaggtgtaaaggttgatgagactcgtttttggtaagcagacctcacagtgatacacagtgttgtatttcatattgcatcatcaggaggctcacaatatcaggttgttgctcttgtggtgctgagttggattgcgtaaaggtggggacctccagatcttccacgggaaaggtacgtttttcttgttgatattgtgaagtgtgtatggggttgtactttggcaccttgtagtgagtcagtttccccccattggtgatcattgccatatcactacatttgaggtttcaaaatgttatttttctccctaatttaatcattctgtttgtagttattagttggcattcttctataacactctttttcttcatcaactagggatgaacttctgttccttctaaaaagacaggctaaagtttacattactttcttttaatgatcagttatttgagtagcttgtgtgataatcccctccagaggttgctaagttccccctttttcttgatctctctctttacaaagttatcactgtataccgagaaatttttatttactaaatgtttacatacatttaagtttgggtgctcatattacttcatatttgactagacgaatcacttgaaggagtatctgtgttttcttaggatatgctttactagtctttgagcatgtccttgccttccaacaattttcccaagtttattttgagttttcactgctcctgaactagaatccacgcataacgatggtttccatttttctattcctaggggttgctttttctttgaggtgttatttttgagaggtaagaaagtggacaggcaggtgacacattcttccaactttagccttttgccccagaactggtaaaataaaatttgagaaatatcgcgtgagaagaaagcacatattgtattcattttaaaatattaatgcaaaatattgtattaatagtttacaatattaatattttaaaatgaatacaatatgctttgtcttcctttcttaaactcacgtgttccacaggaacggattaaaataataaccttatttttcaaatagcatagttttaaaaggcacatcacatacattgtaataatttgggatgttagaggagcatgaattcattcttgctatagcctcctaacatacacgaggtgagccagattttggttcttaatacgtggagcttatactgtgtttactttagaattgatcaaactgtcattcagggatattggtactgcccaacgttgcagtattaacctatagaaaaactgattagaattcagaacttcaggcttcaagactgatgtttccatttttgtttagtaactttcttggcaattggacttgttacctagacaaaggaaaatattgcaataaagttaaaataaggagagaaagaactaattttaatagagatagaaatgtaacaggcaacgtttatttttttaaaaaagctatagaaatacagtaatatgtggtatgatgatgttttggccagccacagaccatgttaagtagggatcccttaaggttataatcaagctgagaaatttatatctcctagtgacatctttgctgtcataacattgtagcatgacgtatatcaagtgtttgtggtgatgctggtgtaaataaacctgttctgccagtcataaaagcatagcacgtataattaggtacagtacataatacttgataaatattaacaattatgttactagtttatctactgtacttttagtagttattttatagagtgcacttctacttattttagaaaaaagtaaagtgtaaaacggcctcaggcaggcccttcaggaggtattccagaagaagacattgttttcgtaggtggcgatagctccatgcatgctattgcctctgaagacctttcagtggtactgtccagtgatactgatgattctggccttgggtaggcttaagttaacgggtgtgtgtgtgtttgtttttaacagtatttaaaagtgtgtgtttgtatttaaacagtaaaaaaaaaaattaaaaaatagaaaaaagcttatagaatcagaatataaagaaagaaaaaattttgtacctctatacagtgtatttgtgttttaagctaaatgttaaggtgaaagagtcaaaaagttaaaaaatttaatttataaagtaaaaaggttacagtaagccaaggttaatttattactgaagaaagaaaaacatttttctataaatttagtatagatcagcctgggcagcatagggagaccccatccctacaaaaaaaaaaaattaggcgtggttggtgccttcatgcctgtagtcccagctacgtgggaggatgaggtgggagaattgcttgagcccaggaggtcaaggctgcagtgagctgtgatcagtccactgcattccagcctgggcgacggatcaagaccctgtctccaaaaaaagaaatgttataagagaagtggaacaactgtcatattatgccaaaaaaaaagctgttaatctaggagaaaactcagcaaaactttacacagttactgagaaaatgaaaggctatgtgaaagcttaagtatgtcacattggttagacttatgtgttcctagaagacacccccaattagttttgaattatgagttttgattatgtgacattttcagtaactcatcatttaaataatcttgattgctctatatctgtatctgtgcttattactatttttagtattagagcagtgatatctcatgtgctcctaaacctcctcacctctcctgttttttggatttccaaagtgatacatgtttattgcaaaatttcctaactttatatgttttcaattatgtgaaagtcatatcagagaataaatactaacagctctgttatgctcttaatccttttttcttttagaatcccactgtcctttttcattatggaatatctataacctctttctctgtcttgggcctctgttcccctctttattttatcctgtaaatatgttcaaagattccattagaaaaacagacaaacagaaaaaagtacttctcagtaggacccaaagtaataataaacatataggattagctgaacaaatacataccaaatggttaaaagaggttatctcgggaaaagaatataaaaaaagacttcagcattatgcatctgtctttgtaagtatgtttaaggtgtgcctgaattacctgtgtagttagataatttttttttaaggtaaataaaggaaaaaagagaacagttactgtggagaaggagggtcagaatctgggttacagaatattgggaatgggaagaaaaggaagaaaaaaaggcaaactacgttttcaagaagcttagctaagaagagaaggaatgctatagggtcctactaagaagtgctttctccccctgtctttctcctaatggcctctgtgaacatattatatttacaagataaagtgaagaagggaacagaggcccaagatggaaaaagagattatagacattgtatgaagggagagtgagattccaaaagagaaaaggatccaagggcaaaacagaagctgttcgcatatgttatctgattttttggtggcatttgctactctctactctgcttttgaaaattttttatcttcttggcaactatttgacctgttggttttccttcattttgtgttattttttaaaaaaatattttaatcatggagaaactgtagtgaatattataaatatccatgtatttactactaccttaagaagataacatagtgtaagtatagctgaagtctcttgtgttttccactgtaatcacgttctcctgccttgttccccagaattaacctctgtcttgaatttggtgcttgtcactcacatgtactgtttatagttacagttttctttacctttcttgtgcctgggattcattgagtttcttggatctgtgggtttatagtttttacctactttagacgtttttcaccaattatttctgcaaatattttttctcttccttcccctttgctttcagggattccagtacttgtatattggtttggttgactttgtctacagttcactgatatgattaatcttttttcagtctttttcgttggtatgttaaattttagacaattgctgttgctatgtcttcaagttcattaatcttctcaagtatctagtatactattaatctcagtcagttttttatttcagacagtttacctctagaagcttgatttagtttctcttctcttctcctctccctctccttctttttggagacagggtcttgctgcgtcgcccaggctgcagtgcagtgatgtggtcatggcccactgcatcctcagcctcctggcttcaagcagtcctgctgcctcagcctccccaagtacctggggctacacatgtataccaccaggctgggcaatttttttttttaattttttggcagagatggggtcttgctggattgcccaggttggtctcgatagtttcgtttttatttttgtctaattaacacactctatccttctctgtcttcataaacataagggacagagttaaagtaacttttaaaatgtttttgtctactgattctattatgtgtcatttctgggtcagtttttattgattgattttttttctcttctctggatcgtgtttccttgcttctttacatgcttgataatttggatgaatttggcagacgttgtgaattttaccttttgggggcctagatatttttttattcttttaaatattcttgagctttgttttgggatgtagttaaatgacttggaaagagtttgatgccattcagactgcttttttgtttgtttttgagacggagtcttgccccgttgcccaggctggagtgccgtggcatgatctcggctcactgcaacctccgcttcctgggttcaagtgattctcctacctcagcctcctgagtagctgggattacaggcatgtgccaccacgcctggctaatttttgtatttttggtagagacggggtttcaccatgttggtcaggctggtcttgagttcctgacctcgtgatccactctccttggcctcccagagtgctgggattacaggtgtgagccaccgcgcctggctgcttttaagctttttcagtgggactgagcaacatttggttgtagaaggctatccccactgcccagtatattatgagttttcattattcttggccttgcgtgagctctgggttttgttccatttgctgctttctaagattttttcctcaccttgaagtttccttacatgcatgtactgatcaaaactaatctgaagactcgaggggaactctgcagatctctggagctttttctgtcccgctctctcctttctggtactcttacctgtgagttttagctctgtttattctcaacgctttctcctcaacttaaggctgctgggtttcgttgagtttcccccttctgctacagccaggaaactttttctgggcatttacaggactcacctcattagtttctcttctcacagggtccagtgtctgaaagtcagtctttttttttattccattatggttggcagcaattgcttgtttatggaaagccattggtattctaaaatactgttaattatcttatgtgcctattaggtgaagtgttgccatcccaaaaggcttatatttcaagtccttctaaagtagctcatattacagggtgatttctaaattacttttaacagcaaatgaccatctgaagagaacacataggcttgaaatgtaccttactcagtgccagttgggtacttacagatacttacagaagatgcagttagtgtagaatttaacacaaattgaataatcattccctgagtacagccttaaaacctgtaagtattagatctatgcaagcttttttgaaggattattaggtatattaaaaaataatatagtaaggggttagttacatcatgaaggttataaatacacgcctacagtacaggggaaagtggcttcctcttctgtgaatgagcactacaagttgagtgttccttatccaaaatacttgggaccagaagcgttttggattttggatttatttggattttgatatttgcattatacttgttggttgaatatccctgatctgaaaattcaaaatctggaacgtggctaggcacagtggctcacccttgtaatcccagcactttgggaggccgaggcaggtggatcgcctgaggtcaggagtttgagaccagcctggccaacatgtcaaaaccccgtctctactaaagatacaaaaattagctgggcgtggtggcaggcatctgtaatcccagctactcgggaggctgaggcaggagaatcatcgcttgaacctgggaggcaaaggttgcagtaagttgagattgtgccattggactccagcctgggtaacaagagtgaaactccatctcaaaaaacaaaagataacaaaatctgaaatgctccaacgagtattgtctttgagtgttatgctggcacttaaaagattttggattttggagcatttggattgtggatttttggattagggatacccaatctgtagtagtaattagggataaatggtcaagtgacgttgtagttcagaaagggccatatctcaaacaacttaaaccgtataaaactgatgtttgaggtcacagagattagatcattaaaaagtggttgtggttatgatgaccctagacatcggagatgaatgtgaggagtttaactaaaatttgttctttgaaatgtgactggaataatatattagacatactattttaatgtgttgttaagtaattatatgttaactgattaatttggatatttgactatttcatcttattcttacaggtttgtaattgagttggcaaacttctatttttactgggaaaatggaatgtctaattttcaggattgtttcaggctgttttcaattttgtaatcacctatagtttaaatattagaaaggccactcattaattcagcaaacattgtggtcaccctgctatcccccaagatgatggggataaagtggtaggtatttgagacatttcttttcttttttttctttttcttttgagatggagtcccactttgtcgcccagcctggagtgcagtggtgagatctcggctcactgcagtgtccacctcctgtgttcaagtgattctcccacctcagcctcccgagtagctgggattacaggcatgcgccaccacgcctggctaatttttgtatttgtagtagagatgggatttcaccatgttggccaggctggtctcgaactccggacctcaagtgattctcccaccttggcctcccaaagtgctgggattacaggtgtgagctaccatgcccagcctcatgagacattcttgagtcttgtcctgttggaccttagaatccaacggatttaaaaactgaaacataggcatggtataaattcaaggactcttaggagtcattgagtttttttattttacaaaagaggaagttgagaccctcctcccaccccccgaagaaaatgactgcttaagttacacaggctgaatgatatttctaacttgccgtagtgattttcagccttttctattatgaagtctgccaaacttagggatgcctgccctctctgggctagactactctagatgtgataaaaatttcacaagagaaacttcagaatactaagagagcaaccaggtaaagggttttacatacctccttatttttcttcgcaaaatgcaatgcctagtcagtacttagatatcacttccattgttttcagtattctgcttaaaaatgataaactttatttagggagttatgagccttgagccttatatgagctttactctttcatgttgggagcaaatgataattgcaggggtggggtggggaaaagggagtactcaacagagcatgtaatttccaggctatatcctgcatgggataagggatgtgttggcccatgatgacatttacatagctacatacatatgtatttaggtctgagaggagaaaaaccattttttccctctgctctcaacacagcacacttctgtgctgactagatgtgtgaggaggtttttggtgaagcttttccagtggacacctactgggtgtcctataattcaattctgacactatctgcttggaggtagtagtagtctctacgtaaatacagttctggcagtgtctacttggagatagtagtagtctctgaagtatagtgtcagatcccacaggttgggggctcagccccacaagactgcccccatttagatggaaatagtagattgtgacctatgcttctgactgactagttttaaattggggttcacacaaccccttccttgggtttggttaatttgctaggatggcttacagaactcagggaaatgcgtttactagtttattataaaagatgttataaaggatacagatgaacagccagaaaaagagatacatagggcaaggtctggaagggtcccaagtgcaggagcttctatcctggtagagttggagtcctcagccttcccagcttgcctttgccaacccaaaagcacatcacatgttgttaagagtttttatagagcttgatctccagcccccaacccctgcccctttcctggaggttggtgggtggagctgaaagttccagccctctaaccctctaatcctctaatcccgtggtctttctggtgatgagcctcatcctgaggctttctaggggtctcactttaagttacctcattagcattagctgtgatccaaagggcttgtcatgaacaaaagaagaccttcccattacttaggaatttccaagagttttaggcactctgacagaaacaaagaccgaatatatttcatattataccacaatagatctatagctgtagctggcatttactgagcactgttgcactatttattgccactattgacctaacaagtcagcattattctaagtgccctgtgtatattatttaatcctcacacaacagccccattagataaagtaaggtaaagtcccattgggcctgtctcaagtataccctgttaggctttaaataaaaggctgtaatttgatacatattaataatagtaataacaacattgatagtgcttactatttgataggttctaccaaatggtatatatgtattaactccttttcataacgcttaacagtgaaatgtggtttagtctgaaagttgttagtgcagtccatgtgtatttgaaatgttaggaggaggaatggggtataagaggcaagtaggaacagttcagttgtttgaacttgaggtcattcataatatctgtaaactgtgaggaaactttgtggacaaaaattgcagataatactcttccttattatgcattaaaaatttgttagaaaatttcttggattttaaaggtttttacagacaggatctcaccctgttgcccaggctggagtgcagtgctgcaattacagctcactgcatcctcaaactcctgggctcaagccattgtccagtttcagcctcccaagtagctaggactacaggcgcaggccaccacatgtagctaacttcactatggcatttgtataggggagtgtggctggaagcttatgatactgaaagccagttgcatatccctctgccatgtcccctgtgtctgttagcctatctagctccagtcctaatgatcttggagacaggacatgaattcacaaagttagttgacttaaaaacaaagacttcttgaggagtttgaaaggttacatagttgtaactatctttttgtggtggttttttttggtgtgtgggggatcagtgaaatggatttagtaaggcagtaaagttaaaatttgcctttgttggtaaaatgttatttattcacttttttagcaaagaaaaaaaggcaagttttagagataatattttaaattattgtattttgtttttcctgctccccttctcaaaaaaccacatggaatattccattcattactgctcgagaaagtcattactttgcaggctgcagttgctgaaatggtttagtggaagaaatgtttgcttgcatatttttagtgatttttttttttttttttttttttttttttttggtggttgtcatttgagtatccaaactgtagctaacgaggagaagcagatttaaatttatatcgggggaacctctttgtggagcatttcatcagatgacttcctgtcaacctcatatcttgaaaagagggattaatgaaacagcatctgaagaagcagtggactcttgtggaataaaccctgacatcttccacagtgttttgtgggataatttcaagttcttcagatacagattacataaagaagattgtagggcacgtgacagactctggtttcttgtattttagatagtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaaggtaagatataatatgcttttctgtatttcattgttagtgacagatgtgagagaccctttgttcagtgtcttttaaaaataaggtgtaaccattgttatagatttgaaaatagatgtgtgaatccatgtgatgcttagtttatatcctttagaaagggcggtattttgaaatgtgttttagatagccaaaagcgtgttgcacagatgttttttccctgagatttacaggaagcctttctcccagcagcaagggtctgtaaagtcctgattatatttaaatcttctcagtgtattctcagagctactcttctcccctttgtgtcccaacatgccatgctagttgaaagtataactcgttttgagagcattttctggactcttccatctattataattatagttaattttttgtttttttaggaagaggaaaatagtcaagtgctgattgtgttgcctttagaaagatgttgatgtggatttaaaatgattagacttgtacaagcactccttgaaagtacttgttttgaagtctgttttgctcattgtgttcaaagtgcagcatgcttcacttaatctctaagtttggcttcttttatttttgagcaccagtttgcagacattgtgtgatggtgttatagattcagcgtgcttacatttaaaattcatccattggtttttaaaatatggaataatttacctttttttatttctatgcacttacgatgtctcatagtgattgctagacaaacttgttgagattttaaaattacattcagtaataaaagagtaggtaaatttgtaaattctgaaagtagaggctattactctttctgtataatgaattatttttcataagaggaaaagcaggaaaattgatggaaattagttttcttttcttgttgctcagagttctagttcaaacagtagtttctgatcggatacagacatgcccattatctgtttccattccctgtttataaggagatgtcttctctgtacctctaggtaaactgtcttgttgaaatattcttactgaatgtttaaagggcacataatcctggaaaacagggtcgttgttgctttttccctctctaaatttttttcatggttgtctatgttggttctcccctgtgatttgccttttatcatttcattcattttggttttatttccagtattatagcaaggttatttgaaatgatctatctcctctctctgctccatcttccttgatagactttgaatttttttacattgactcttttagcaaaagagggtctattttgcttaaaaaattagatgtaatcattatcctaaagtatttataaatttttattatataactgttaaagcaaaaatagagaaggatgtaggttggaaattagaagcctaaaacattgtttgtagttgcttttgaaaaaactaaattaaaataatttgttctattattagaaataaaccctttgaacatatttaaccaatggctctagcaggaagagcaaaattcttgattttcttttgaactaaaggctgcggtgtgtaccccatcccttgttcttttctcccttttctggtcttagagagctttgtgattctatatgtgttttaaaagtctgacagtgtagttgatgtaattttatcatgttaatactaaaacacctttccaagtgaaatttttttcatcatccgcctcccctctctcccacttgtgtaggcacggtgaactaggtaggcacgttgcatcattgctaccatggatacccttaagtacaggcatgtgggttgagctaaagcaatgatgattagttttttggttgttcccccccgcccccccataactatatgttcttcacaatgaagaatctgactttaaaacgtttgcaaatgacaaggttgtgagatgtgatgactaaaccatcactgctactgaactgccaaatcttggtctccatttacagtagtattaatgccatttactaatttaaggctgtcataaatagctctgtattccttttctgattaatatgttttaaatccaagtgtaatgtttgttttgttttgccttttagtgaaaatgaaaatgtacttctcttcgagttaaaaaaaatactcttctggatttagatattttgtgggacaaaaagatgctagtgagcatttctagcatggcagcgtttctgattattgttcatacacttatatacatttttatgtactttaatcagcttggttacagtattttgtgcttttccacataatgtctaagagagatttatttttgtgtttgtaagttcttgtgttcttagctagctgctttgcaaacatgtccgttgaggtggagttaatattgttagaggccaggcagtgaagtgtcatttttgtcaggctcgtaatcactgtaggaaaattaactcagagcataaaaggcccaacaagagtgatttaggattattgttatatatggtatattttcttatgttagcaataaagcactctgcttaaaccgcagctgagggcatttcgtgttctttagcatggaggtttcccagctgtcaagtaacttctgagagtaactttagtaccagaatttcttgtaataggatcatgtctttctttaagttcaggtgtttcattaaggcaagctggagataggaataaaaggattatgaaagagaaggagcttgaaagatgcttttacccatacctgtttctgctttgtcagcctctttttgctgcctttattttagattttagagtgatgctttgccttgtcttcggaaacagttccctgaatctcctacttgccaaaagttcatgattcttttggtgattctttatatgggtaaagaaaatgtatgcccgtgtgtggggatgtttgtcattccagtgggtgcccagcaaatttgttttaacataactgatagaattttaggaattaagtcaccagagaactgttgaattgttttggtttatcagtttgggaattatgaatacaaaatttgactcctttgggtaaaacagctatcttttatttaaatattcatatttatattagggtactttcacttgtaggttgtattaaaattgtatgttagaagctttgaaaggggtattaaatatgttaaaagaaagtctcagtacaggtatttcagattttttagattttttttaaaagacttcaaattttttaagttaggttttaatagtgaatagaaatgctgccctctactgttggctgattgtttgactgccacgtaaaaatgttcagtaacctgtaatagaattttttagtgtagatcatattactgtgttgaagtataattatgttaaacgttttccttataatttagttaagttataatcaagtgtttcctaataatgctaactactattaaataagttcattaccattttggcttttagaaaaacttgagtcctggagaaagtttcgtttagtcttagctcctcattttatatggtgaggttttagtacttcctagattgatcccttatggttgtgtgactgaaagctcgtattgataacttataaccaaactataggtaaagatacatttttctaaactaattatttttagtttatgctatgtaaaatgtctgaacttctgaaacttatgttttacatgtaaaaaaatttggaatttaaatcactattaaatctttgcatgtttattaaaatgaggcactgctttaaaaagtagtactgttgagcaaatttaaacctctgattgatgtttttcaccgtgagtggagggattagaagagacggttttaaagattccttttagcttcgctgagtgcctactgtgtgtgaagtactgtagaaaataaacacggaaaacaaaggctattatagttcttcctttagatcaggagttggcagactatggccagtgggccaaattgggccacactcactcatttacttaccttgtatggctgctttagtgctacagtggcagaattgggtagttgcagcagtgagcatatggcctgcaaagctgaaaatacttactctctagacttttacagacaatgtttgctaacccctgccccagatgaacttctcatctagtgcagaagatatatctaaaaagaatcattttaaacagatgtttataggacacatagaatgccaaataaagctagcatgtcattaaaatatgctttctttattagcgccattcttcctgttcagtagtatcttaacatcatctaataattcccaaagattcttgtttattggccatttgcagatatcgtacctcacagcctggttattttcatcatcatcattattttttctgtgtgaactgcacaaatctaagtacgcagcttgatgcctttttataactgcaatcactatccatagaaagacacaaaacatttccagtactccagaaagactcccattagctctttccaagacagcccaccctccccagagataatctttttttttttttaactcatatcactatagattaggtttgaacgtcatataaatggaatcatgcagtatatatgattaattatggcttcttttactcagtatctgtgttactgtgcgtgctggtagcttgttcctttttattgctgtgtaatattccatggtgggaatttgaattgtttctactttttggttgttatgaagaaagctgtgtaaaacattttatacaagtccttttgtgtacatatccactaatttctctcaaatatatacctgggaggtaggatttttaattcacattgtagagcccttaccacaaagtttttgtttaataggacaaagcaggaggcaggaatcaatgacacactttcacttactttataagttcacctagtcccctgcttcattacaaagtggtgactttacattttttcataagcactgtgattaaggcaacctacgttttgactaaatcaaacaggttttatttccaatgccacctcttattggtgttggtgtctagaggtctttgctaagaattctgataacaagttgaaagtgctgtgattgtctagtagtctttgctgtgttgagggattagagatgtgtgggggaggcatgtgacagaagaatgggatcatttttatttaatatatttgaaaaattcttacatattgaatatagtgcatttaaaattacctcattgcttgaacaggtcatagatttttttttttgagacagaatctcgctcttgtcacccaggctggaatgcagtagcgtgatctcggctcactgcaacctccaccttccaggttcaagtgattctcctgcctcatcctcctgagtagctaggattacaagcacgtgccaccacgcccggctaatttttttttctttgtatttttagtaaacgtggggtttcaccacattggccaggctgtcttgaactcctgacctcaggaggtgatccaccaacctctcaaggtgctgggattacaggcatgagccaccacgctcagcctttgaataggtcatagatttcttaatttcatttattgtatttttaacttttagaatgtctgtttgctctttttagagtttctatttctcttaaatttgatattgcatctaatttgtacatcttttcctgtgtatttaaaaattgccattttaaagttcttttctgctataatagttctaacatctgtggttctgctgtgtgggttttcttttgattgttttcctcttatgttatcctacttctttacatgtcttaaattttttattgtgctctaaataacgtataaaagaaccattgaaagcgaagcagtgttctttccttttcaggaagctgcagtgaggctgataaaataggagttgaatttgtttagcgttaggttgctgctttagttactttcacctggcttctgttttcagctgtcatgagggtgggagatgagttttgtgtctttcattggttctttccactagcatgactttagggtgtatgaactgtgagactgcagaaatgtttcatggctttatagccccattctcagcctgctacactgctgtaccctcagtaaatgccccatgaaggcgatctaatgtgtggggacaaataactctccattttaggatcctccagattctaactggtcatgccagcccacgtcattaaaggctccactccttataccatcaaagtcactcaatctgtatcaggtccattcctttgcccacctgagtctaggcttgtcagatacactgtttaggtaagtgtctgccttcttacaaaaggcttctttctttggggtttagattctttccttcgtgtgcagaaatttccatttcctttttttttttaattaaacctttaattttgggttaattgtagatacatgtatgtttgtaaaaaaataataataatgcagaaatcacatgtgcctttaacccagtttcctctagtagtaactctagcatagtatcactaaccaggatattgacgttaatagagtcaaactacagaacatttctgtcaccacaaagatcactcgaggcctttttctagccacacctactttcctctcaccccatccccttcttaactcaaagcaaccactgatctgttctctatttccattattttgtcatttcagcaattctatatgaatggaataataaatatataaactttcaggattggcttttttcactgagcataattttcaagagattgccggggagtgaaattgatgggtcatatgatagttgcatgtttgcttgtttttttaaagaaactgctaaaccgctttccagagtagctgtatgattttacatttccaacagcaatgtgtgaatgatcgagtttttccacatccttgccagcatttggtgttgcctcattttattttagtcattgtcatcgatgtgtagccacatttccctgatggcaaatgattttggacatcttttcatgtgcttatttgccatctgtgtatcttttttggtgaaatgtctcttcatggtcttttgcccatattcgaattgggtggttctttttactactgagttttgagaattctttatgtaatctattatagtgtactagtccttagtcagatatatcatttccagatattttctcccagtatgtggcttgtcttttcatcctttctttaaggatctttcgtggaacaaaaccttttaattttgatgaagtccaatttatcaagttaggtgacaaatctcataactctttgcctaaccctaggttttgaaaattttctcctgtttctcctgttttttcagattaagttcataatccattttgggttagtattttttttattgtggtaaaatatacataacatacaatttattatggtaaccatttttatgagactgacatgctgcccactgcgcaaagaggacgattattctaaccattttaaagtgtatagtaaaatggtattaaatacattcatgagatgcagccactaccactattcatctatagactctgttctaatcttgtaaaactgaaacgaggacaattatcctaaccattttaagtttacagttaagtggtattaaatacatttgtgaaatgcagccgttaccactatccatctacaggctcttttcatcttgcaaagctgaagttccatagtcatcagacataactcctcattccctcatcagacaataactcctcattccctcagccatcattctactttgtttctctgattttaactaccgtaagtaccacataaaagtatagtcagatggtatttgtcttcttgtgactggcttggttcactcagcatcatgtcctcaagtttcagccatgttatagtatatgtcaaaatttcctacccttttaaagctgaataatattctattatatgtctataccacatttttcgtatccattatttcgttaatggatactttgtttccatattttagctattgtgaataatattgctatgaaaacagtataatctctttgagacactgcttttaaaatccaaagtaaaagcagtaaaagaagaggtttataaagtagaaaaagaaatgggtagaagcatctttaaatctcctccctttcatattccttttattcctacctccagcttgtctcgatgatagacctgtacttaaaccatccaccacctctcataaggagagacaactagcacactagtcataaaaagcaaggaacaagaactataaaagagggaaaagagaaagaatgattcagaaaagactgttctgtacagccaggaacctacatattttactgtttcataaaaattatcaaaaagatcttctaacaattagtgaatcttaccatgtactgggcattgtttcccacactcgacaggtctattgagaaatgtctgttcagatcatttgcccattttaaatgtgcccattttaaaatatgattatttgtttttttgctattaagttgtttaagctcttaatatatcctggttattaatcccttgtcagacgggtagtttggaaatattttctcccattctgtgagttttctcttcactttgttgattgtgtttttttgctgtgcagaagctttttagcttgatgtaatctcatttgtcttttttagctttggttgcctgtggttttgaggtcttaacctcaaaaaatcattcattcattcattcttatgcatatggatatccagtgttcccagcatcatttattaaagagactgtcctttccccattatatgttcttggcatctttgttgaagatgagttggctataaatgcatgaatttatacctggattcttttttcttttctgtgtgtctgtttttattccagtaccgtgcttatttggttactgtagctttgtagtaaatttgaagtcaagtagcgtgatgcctccagctttgttctttgccttgaccatttggggtcttttgtggttccatataatttttaggattttttttctatttctttttctgtgaagaatgtcattggtaatttgataggcattgcctagagtctgtattttatttatttgtttttttgtttgtttttgtagagactgggtttcaccatgttgtccaggctgtagtcaagcagtccacccaccttggcctcccaaatgctggggttacaggcatgagccaccgtgcctgtccctgaatctgtagattactttgtttagtattgttatttttacagtattcctccacttcatgagcatggaatagctttccattttgggggtcctattcaatttcctttttttttttttttttttttgatggagtcttgctctgttgcccaggctggagtgcagtggcatgatcttggctcactgcaacctttacctcccaggttctcttcacagcctcctgagtagttgggattacaggcacctgccactgcgcctggctaatgtttgtatttttggtagagacagggtttcactatgttgtccaggctggtcttgatctcctgacttcaagtgatctgccacctcagcctcccaaagtgctggaatgacacgtgtgagttcattttctttagttagtgttttatagttttcctgtatagatctttaacttctttggttcaattgattcccatacactttatattctttgtagctattataaatgtgattgctttttaaatttctttcttctctttttctttttctttttttttttttgagacggagtctcactctgtcgccagggctggagtgcagtggcatgatctcggctcactgcaacctctgtcttgcaggttcaactgattcccctgcctcagcctcctgagtagctgggattacaggtgcccaccatgacgcccagctaattttttgtatttttagtagacctggggtttcacaatgttggccaggctggtctcgaactcctgacctcgtgattcacctgcctcggcctcccaaagtgctgggattacaggcatgagccgccgtgcccggtgctttttaaatttcttttcagattgttcactgttggtatatataatgctattgatttttcatgttgattttggatcctgcagctttactaagcatatgtatcagttcttacagttttttttggtgaagtctttaggtttttctaggtatgagatcatgccatctgtaaacaaggctaatttgacttcttccttttcaattttggtgccctttatttctttgttttacttcactgcttttccagtactatatgaaataaaagcggtgaaagtaggcatttttgtcttgttccagaccttagaggaaagaccttcaatttttccccattcagtatgatgttagctgtgggtttattatatatggcccttttaattttgagctatgtttcatctgtaacagtttgttactggtttttatcacaaaggtatattgaattttatcaagtgcttttttggcatctattgaaataatcatggtttttgttttcggttctgttaatgtgatgtatcatgtttattggtttgtgtatgtcacaccatccttgcattcctgaggtgaatcccacttgattatgatgcgtgatccttttaatatgtggttgaatctggtttgctaatattttgttgaagattttgcatctaatttcataatcagtggtattggcctgtagttttctttttttgttttatccgtgtctggttttggaatcacagtgatgctggccttgtagaatgaattccaaaacattcgattttttttttaaagagtttgagtagaactggtagaatttattaggacgccattaggtcctgggcttttctttggtgggagacttaattttttgttttatttttaaaaattttaatatttagtggaatgggagactttattatggcttcaatctcattacttgttatcagcttattgaggttttctttcttcatggttcaatcttgaaagtcatgtatccaagtatttatccatttcttctagtttttaaatttgttggcatatagttgttcataatagtctgtaatgatttttttgtatttctgtggtctcagttatgttttctttttcatttctgattttatttatttgagtcatcttttttttagcctagctaaaaggtagttgattttgttttgttgatcatctgtattttgttttattctcaattttatttattactgctatgatgtttattatttcttttcttctaccaattttagatttggtttgttcttgcttttctggttccttcaggtgcattatttctttgaagtctttctcatttttttattttttgagacatagtcttgctctgtagcctaggccagagtgcagtggagtgatcatacctcactcttgtcttgaactcctgtgcacaagtgttaggaacagtttctcttcaaacaaagggtttcaccctccttgtcttttgttctagtatataagtaatctttcttgcctttaacacacccaggcatgcctccgtccaccaagcttgtagccgacccacgctgccttactttaagttgttaggtacaaaaaataaacttcctggttctttgtcctattctaaatgctaaatctagtcagtcgggatcagtttagattgtgtggtcctaccccagataacaaggggaggacacagaaacaggaatggcgttaggaataaaaacccctgctttcctttgttcagtgtgctcttgtgattgtaactgatgcaggcagcacccttctgaaatttgccttgctgagaagtcttttgtttgagtgctcattttctttgtgactttgagctcttctaacaaatttgggggctcatctgggatcccattctcctctggggaaaggtctccaagcatctctcattaggagacgtgtcccactgcctcattgtggtggcctcaggggtaagagattgagacccacctggcatgacgaataaacccgggaagaaaagtcctacaagtagataccgcagcagccaagtaactctgcacagaccaaggttagaaaagccgtgggggcagtgaagtatttccttggtggtcgagatcaaagtaagaaaagccagggggcggtgaagtatatcttggtcagaacataccaaggtaagaaaagccgcaggggtggtaaagtattcctagtggtcaggttatcttggaggttgaaagtgcatgaatgagattcaggcacattaagtgtagagtgagtaagtccaatctgcagttccgtggtcacctcatatggcttctgatggcggccctcctataaaggagtcaaagtcaaaggcttatactgaacctgccagtgctaagagggacctaaagtccctctggggaagtggccatagagggtgaagcgaaacaagaagagtgcaagggacctccagtaggtggggttaagcctctagggagagggaaggcaagaaacctctaatatgaaggattgagcctaacaccaaacctccaggatggggactatcccaagtaagacaagaaacagaaagtataaggctgataacattccccttaatagtcccttaggtctcatgttaaaataatactggaaagataatgagaggactaaacataagagaaagcaacagatgataaaatattgttgtttcatttggaccaaagaacccatccttgagccctcagttttctggccaaagtttaggtcaaatgaggattcgaatttgtcaacttttaataaagtatgtcaatgacaagagtcccgtttcccaggagaaaatagattatgccctgtgttggcagcagggacctgtcctcctttaccccctaaaggtatagggggcaagccagaaaccggctcctctgaaaggagtaaggtctctacccctgaacagcccactaacatctggacccactagaccacctgtatctgccaaatcccccgccccaagtgggtgcacaggaatctcctcactcagttcctcccccatataatcctgaatcaatgttctctggcctccctaaccacacgcctgagtctatgtctccccccaggaaggctccagcgtgagataaaacagtgcaacaaagatattcagaacttccctttcccctccacctctaagcaatcaactccaactctctttcccttaagggaagtgccccttggagaaggaagcatcggctttgttaatggtcccttaactagctcagaagtccaaagtttaaaagaggaactcagatcattattaaataacccctatgggattgcagatcaaattgatcaattcttagggccacagctgtatacttgggctgagtgaatgtccatcctgggcatcctcttttcaggggaagaaagaagcatgatccatagggccgctataatagtctgggaatgtgaacatccatccaaaacattcctgcagcagaccaaatatttccagcccaagaccctcaatgggatggtaacaatacagctcacccaagaaaagcctgaccctcttctgtggacttcgatgaaatccactaggttgaggagctaaaacacctacccatcgctattcctgtcttagcgctgccatccctagaaaaatcatttcaccttttcattaacgcaaacaagagggtgactttcagggtgcttactcaagaacatgggggtcaccaacaacctgtggccttcctatcaaaagtttaaacccagtaacctgtgggtggcccaaatttattcagtctattacagctactgccttaactgaagaaagcaggaagctaacctttgggggaaacttgatggtgagcacaccccttcaggttaggacaatcttaaatcaaaaggtaggaagatggcccaccaactcaagaattttaaagtgtgaagctcccttactaaagagagatgacttaacactaaccactgacagttcactcaacacaccaggtttcctgacagggaacccaaacctaaaagggcctaagtgtaagtgcttaaatttagttaattatcgcacagaggtcaggcctgatttaagggacccctttcaaaacaagacaacagctattcatagatggctcctcccaggtaattgaaggaaaaaaacataatgggtattcagtggtcgatggggaagctgtcgcagaagtcgagtcagaaagactgcccaataatcggtccgctcaaacatgtgaattgtttgcaataaatcaagccttagaacatttacaaaatcaagaaggaactatttatactaattccaagtatgccttcagggtagcccatacctttagaaaaatttggactaaacgaagtctcatcagtagcaagggccaagaccttgtccacagttaattaatcacccaggtactggataaccttcatttgccacctccccccccccccaaaaaaaaaaaagtattgtccatgtcccaggacatcaaaaaaaatctcttttaaaagacgagggaataacctcgcagaccaaagagccaaacaaactgctttttcctctgaaacatgcattttccaccaactcattgtctttctcccccaactgccattcccatcttcactcccgctgaaaaggagaaattaataaaaataggagccaaagaaaactcagaaggtaaatgggtgttaccagaccaaagagaaatgctaaccaaatctctcatgagggaggttttgtctcagctacatcaagaaacccactggggacctcaggctatgtgtgatgcagttcttaaagtctatggatgtataggaatttatactctagcaaaacaagttacagataattgtctaatatgtaagaaaactaataaaccctaagaaaaccaccccttggaggaagaaacccaagattaaggccactccgaagtatccaaattgattataccaaaatacccccaacaggccgcctaaagtatctactggtgatagtagatcaccttactcactgggtaaatgcaatttctttttcaagtgcaaccaccaacaatgtagttaagacactcatagaaaatgttatacccaagtttggattaatagaaaacattgattcagataatggaatccatttcactgcacatgacaatataaagctagcccagatattagaaataaagtgggaataccataccccctggcacccaccttcatcagaaagagtagaaagaatgaaccaaaccctaaaaagccatctaaccaaattagttttaaaaactcgattatcatggaccaagtgccttcctattgccttattaaaggtccgaactgtccctcagaaagaagttggcttatctccttgtgaaatgctgtataggctgccttactcacacttcactgttgacattcctacgtttgaaactaaaagtcagtttctcaagagctatgtacttggtctctcttccactttctcttccctcaaagctaaaggctttttagtacagatgccacccttggagttcccagcacatcagcatcagcctggggatgatgttctcatcagaagctggaaagaaggaaaactcaaaccagcttgggaaggaccctatctcgtgcttctaaccaccaagactgcagtccaaacaacaacaaaaaaatgcagacccatcataccccagtcaaaaaagcatcgccatcttcaaagtcatgcgctattgttccgagaccaattcctaccaagctaaagataaaaaaaaaaaagcttaaccctcttatagtgcctttttttctttcccctctctactgtcagacaattatcctttcctcacccagtaacaaaaccaaagtggccgtcgtagaggtaaaagatctaaaacaaacctaatcattgaaacagggtaccgagatgcaaatgcctggctgaaatggattaaatattctgtctgcactctaaacaaaaatgattgctatgcttgtgcgcacagcaggccaaaggcccagattgtcccctttccactcgaatggtcctccagtctaccaggcatgaactgtatggtagttcccttccaacacctcacatcctggggtaataagttatgccaagctccctctctgctattccctcaagtccagcaccctgcgggtcagcccccaagggccatcaagcttccatttccccatgccagttttacctcatgtctctcacaacacggggaaaacttggcatttcttggagacctaaagggatgcagtgagcttaagcccttccaggagcttactaatcagtctccccttattcatccccaagcaaatgtaggatggtattgtggtggactattactggatactctgccaagtaactggagcggcacttgcactctgatccaattggatatccctttcactctggcatttcatcaaccagaaaagataaaacatcgtaaaacaagagatgtccctcgtgggtcctttgactctcatgtttatatagacgccgttggagtcccacgaggggtacgaaatgaatttaaagcccgaaatcagataactgcagggtctgagtccatgttattctggtggtcaacaattaataaaaatgtagattggataaattatatctactataaccaacaacgatttgtcagttatactaggaatgccattaaaagaatagctcaacaattagggcctactagccaaatggtctgggaaaataggatggcgctaggtatgatattagcaaaaaaaaaagaggtggagtctgtgtcatgataggaacccagtgttgtaccttcatccctattagttgaaagacatattacaacagcccttactgaaactttcctgatttcttttccaccctagtttaacaaacttttacttctagacagtgaggaacagcaaagtcaggtcatgttaggtaagtttgaagaagaaagtgtgtaaattcaagaggggaaaattgttaggaacaaacagtttctcttcaaagggtttcaccccccttttcctttgttctattacataagtagtttttcctgcctttaacaggcccaggcatgcctccatccaccaaccttgtagctgacccatgccgccttactcgaagttgttaggttcaaacaatgaatttcctggttctttttccttttctaaatgctaaatctagtcagtcggaatcagtttagattgtgtggtcctaccctaattaactgggggaggacacagaaacaggaacggcattgggaataaaaacccctgctttcctttgtttggtgtgctcttgcgatcgtaactaacgcaggcaacacccttctgaaatttgccttgctgagaagtcttttgtttgagtgctcattttctttgcaactctgagctcttatttctaacacaaggcatcctcttgcctaattcttcaagcagctgggactacaggcatgtccagactgcaggatcttgaactcctggtctcaagcaatcctgctgtgacctcccaaagtgctgagattacaggcatgaatcatcatgcccagcctatttctacttttttgatgcaggtgtttgttgccataaacctgcttaatactgcttttgctgtattccatagctttggtatgttgtgtttccattttcatttgtttcaagtttttaagtttccttctgaatttcttcattgttcaggagcatgttgtctaatttccatacgtttttgaagttcttgaggttctttttattgatatgtatttttattctttttgtggtcagaaaagatatttgatatgatttctatttttttttttatttgttcagactcatggcctatgataatggtccattctggagcatgttttatgtgctgataaaaagaatgtgtattctccagcagttgggtggaatgttctgtaaatgtcagttaggcctattaggtctagtttgtagtttaactccagtgtttctttgtttattttctgtctgggttatctgtccatttctgagagtagggtattaaagtctcctactattattgtattgcagtctatccccttggatgtattaatttttttatatatacttgggagctctgatgggtgaatatttataattgttatatcctcttgctgaattgactgactcctttatcatcatatagtgaccttctttgtcttttttttacagtctttgatttgtagtccactttatctgatagaagcatagttgctcctgagcttttttggtttccagttgcatgaaatatcttttccctcccttttaatgtatgtgtatcttaataggtgaagtgggtttcttgtagacagcatggaattgggtcttgtttctttctttgccttttaattggagaactgagtgcatttaccttcagtagtattattgataagtaaagactactgccattttgttgcttgttttctgattgtttcgtaactcttcctttcttgtggttaagagattttctctggtggtatgttttaatgtgttgctttttatttttagtgaatttgttataggtttttgcatcgtggttaccatgaggtttacaaaaaaataacaaattatcttaaagagttgacaacttatcttagatcacaaaagaatagaaacaaaggaaaatttgaaagaacttccacaatttaacttcatccctccctctaagaattcattagaggcttttaattgtctcagtttatctatttttatattatctgccacttaacaggttgttgtaactgttactgtttttgatagatttatcttttgggctttatataatactagagtcgtgagtggattgcataccacaattacaatagtaaagtattttgggttttttgtgtatacataattttaccagtgggttttacaccttcaaatgtttttttagtttgttttatttttcatggtagtgtttttttcttccagattgagtaattccttttagcattttttttgtaatatgagtcttgtggtggtgaattctcttagcttttgtttgtgtgggagtctttatctccccttcatatgtgaagggtaattttgctggacaaggatattcctggatggtagttttggtttttttctttgagcacattaaaaatgttcccgtcccttcctggcctgtatggtttccgttgagaagtctgttgtcatacaaggtagagcttctttatatgttatttgtttcttttctattgctgcttttaggatcctctctttgtctttgacttttcaaatttgattattatatgcctttgggtaatcttatttgggtcaaatgtgttttctgaccttcctgtactaggatatttacatttttctcaagttgtggaaagttttctattatttctttgaataagctttctacctcatgcttttgctcaactttctttgaacactaataattcttacatttgtttttttgaggtaattttctatatcttataggcaatctttgttgcttttcattcttttttctcctatgtgtgttttcatagcctgtctctgagcctaatgattgtttactctgcttgatcctctcttatgtcaagagcctctaatgaatctttcagttcagcaagtgtatttctcagttccaagatttctgtttgatttttttcttttcttttcttttggtgttatgacttggataattttaaaaaattactttaatctctttttaaaatttcctgataaatttctgaattgcatttctgtgttatcttggagatcactgagttttcttaaaaatactactttgaatattggtcagagagctcatagatcactatctcattagtgtcagttattggttccttgctttgtccatttggggagatcatgggtacctgttttctgttgtttgttgtggctgttttattcagccttctctgtctggcttgttttggtttttactggatgtatttgcttagaagttctttactgttaggttgctgcctcctttttagctctctctagttaccttaagcccaggttcacctaggttctagtaaagaaccagagcactgttcttcccgaatgagggagattccaaaggggatgtcccagtagtgtgggaatgctggctaggagttcctgcccaggggacctgtacaataaaccttctacagatggtgttgatgaacatctaatgaacatctactctgattcagtgtcttgcttggctgagttacagtagaatttccagagctggagatggtagtcttgcctcccttttttgtttctgcctatccgcagggatatttttcccttctggcatttgagatgcatcctgtgggctaagataagggacagtctcctgccagagaacattagatgatggggaagcatgagttatatctcagtctcactttttccagtgtagaaacagtgagttgtgggaaaattttttgcccattaggtgctggccagaatgaggggagggacatcatggatgtggaagtccaattctttcaccatctgctagaattctttttttttttttttttttaacttttctgtggcccctgaactgtcgcatcttcatatgagttctgggatattcctggtaataacatcggctctgtatatttgtttttggttttctgtgagaggagtgaagccagcttgcttctgtgctgacattttggaactggaaatcctcttgattaatttttgtatgttgatttattctatattccaggaataaatcccaatcccactgggtcatggtgtgtaatccttttaatatgctgtcaaatctgatttgctagtattttattgaggatttttgtatcactgttcatgaaggatattggtctgtagttttcttttctagtactatctttggccttggtatttggtagtgctggcttaatgaaatgagtttaggagtgagtagtccctcctccttaattttttggaaaagtttgagaaggattggcattaatttttctttaaatggttggcagaattcaccagtgaagccttcaggtccaggacttttctttgttgaaagatttttgattacttattcagtgtctctgctaattatagatctatttagattttctctttcttcatggtttagtcttgataggttttgtgtttctaggagttttccatttcatttaggttatctagtttgttggcatttacttgctctatataggactctgttatcctatttatttctctagaattgattgaaatgttctcactttcatttctgattttagtaatttgagtcttctttctctcttaattccatatagttaaaggtttgtgtttttgtttatttaaagaaacaacttttggtttcattaagttttttcttctgtttctctgttctctattttgtgtatctctgccctcatctttattatttttttcctcctgctaaccttgtgtttcgtttgttcttgttttactagttccttaagttttagactaggttcttgatttgagatctttcttgttttgtaatgtaagcatttagagctatacatttactccttagcactgctttcactttataccataaattttgttatgttgtgtttttgtgttcattcatatgtaaatatcttctaatttcctttttgatttcttctttgattcattgcttgtgtaagagtgtgtttaatttccacaaattggtgaattttccagttttccttctattactgatttctgacttcatccagttgtagctggagatgatagttcatgtgctatatctatcttttcaaatggattgacattctgtatggtgtctcacagatcccttaggctgtattcacttttcacttaaatctttttcctctgttgttcacattgagtctttagtgttattgtattttcagttctgtcatttccatatagttctttgtgtcttgtatttctttgcttagactttctatttctttgctgtgagtttttattatttcatttgtttcatgtatatttgtaattgttcattaattttttatatgacgcctactttaaactctgttaggtaagtctaacatctgtggtgtcttgatgttggcatctcctgattgtctttttatattcagtttgagatattcctggttctcagtgattttcaagggaaacttcgacattttttgtattgtgagacgctagatcttatttaaaccctgtgttttggctcattttctctgacgctgctctgacagtgaaaggtggggcactgcttccttactgcttagtggaggtaaaagtcaggtttctcacactgcttccttccacacctaagagagaatactcctcactcctgttgggatagggtgttagttatagttccccatgtggtcttcactaacactgcatggggtagaagcttttgttaccagtggatttggatgcaagtctaggcttcccacgtgtctgcttttggaatcaagacagtactaaaacttcataaaatcagttgagaactgctgggtgccagtgggagttccagctccccgttagttctccattaatactggctagaagttggaatgcctcattactgctcctcatgtgacagtatgtagaagtagggttgtgcaccttgttactgctggatagtggggaaaatcccgtctcctgactatacctcttctaacattccctctacccccggccagtggagagggctgtctctttattgctggatgggaacaaatgtcccagctccttaattggccttctctgacccagctccagttggggaagatggttgggacaccttgttacagcctcatgagagtggaattctaggctacctgctggtctttgctggtgtgtatatggttggtgacagagtttttttctgtggtgtttagctggaatagagcagttgtcatctaaaagttgtatcttgctaggctgcccctttctgttcctgtggcaacaaaagcctaaaagagcttctattggtgtctctcttttttggcacaaggtaggtctgtaccattggcgtttctgggttgctcatttcttcagctgaaatcctgggatagtctgaggtaaaaaagaaaactcagggactgactgccgtgtcttccttagggttctacattcctagctagtctgccaccctcttttcacctttcagtcttatttttgttttatatataatggccaaagattttagttgtatgtagcatgtggcataggaaagtgtctacgctctctttcaattggaagccctcattgtctttaaaagatatgtttatcttttttttctagttgttatggtacaagccattgtctgtgtgaccttccacattctgatctgagcaggagctcccagacgctagttattgtgggttgtttttgttttttgcactcttaaattttagtcaattaaatgactgcctgtttgttctccagtatgtaaattaaataacctttcctaattcatagtttggtagtaacagaattcattatggacagcaaatgatgtttgaataaaataatatatttattttgaaagatgaatattcttgaataaaacagcaaatgttaacagctaaagtatacttagcatttgttgatctgcttcctggtaagatttcttcccccatctgattatagattgtttaccacctccgttacttggtaaaactgtgaaaatcgacttttcttgactttggttctgcagctgtagctttcccctgtccccctttagggacaacccacctttgaaactaggtctagtgctagtggagagaggtaatgtgattgggcgttgagtcccataaacactgagctgagtagtttggactttatcccataggcaatgtagggccagccaaatgatcattttgaacagtagttcaaataaagttgttaatattcacacagtgtttgatggtctttattttatcttgtaggtcacctgatgtattttttttcagcgtgaagaacttctttaacatttcttgaaatgcatttcttctggtgatgaattctctcagctgttgtttacttgaaagaagtatttttattttgtcttttttttaatttttgagacaggatctcactctgttgcccaggatggagtgcagtggtgccatctcagctcactggaaccttttcctcccaggcttaagtgatcctcctgcttcagcctcccaagtagctggaactacaggcatgccccaccacacccagctgattttttactttttgtagagacgggatttcgccatgttgctcatgccactcttgaactcctggtctcaagcagtctgcctacctcgggctcccagagtactgggattacaggcatgagccaccatgactagcctgcctttatttttgaatgatagttttgatgaaaaaaattctgggttgacaggttttttttcccagcacgtttaaaacctcattccatttggtatgtttttattggttccatttctgtcatgatattcatgttttcctttaagtccttgagcatacttaagttttatgagtgtttttgagtttttatctgctaattctgtcattttgcatttctaagtctattatgaactggctttcctcctctgatggctcacagttttctgcttctttgcatatctggttatttttcattggatcccagacattgtgaatgtaattgagtgttcctaagtactgttttctctggaaaatactgttgtttgttttggaaggcaattaagtcatttgcagataaggttgatcagttcaagactttttaaagctttttaaaagttggatctcaagtagccttttctttaaggccagcttagccttaatgctaaggcttgactgtctaggagtgtccactgattactacaagtgtttattgaggcccctctgctctgtataagtttgaacactcctcagcttactgtgagctctgaagcttgtttataagtcccttacagttttatttgcctggccttgttgaattttatgctgttcacgtgttgattagtattcagactgaagtctcaagggtactcactatttgatttctggagctctttttctgcttagccttcttctttccagtattctgccttgcacattccagtgcttccgtctccttgaacaccagtcttgatttttgtcaacccagtaagatggctgtattggcttgggtttctccatcatgtgtcaagttccaaaaaatggcctccaggcaggaagccaggaagatcgtagagctcactttgttttccttctctcaggtattgtagtcctgtactgcttgttgtccagtgctgaaaactgttgtggcatgtattttttttctagttttctagttgttttaaggcagaaggtcaagttctgtaccagttaacttcttcatggcctgacgtagaagttttttcatattttgtttatttagatcctgtttaatttcacaatagatttaagctggttactctggaatagaaactactacttcagtagtttccttaaaaaacataacttttgacgtgactttttgggatgagggagatacaatgtatgttcattgtagagtttagaaatacacaaaaatgaacctaagtctcatgtaaactcagactccatatcttacctctattaacatttttctgtgttctagtcatttttctgtgattatatatataaccccttttatacataattacggggcataaacagacatacagccctctttctttgttcccccagtttgtattgtgtttttgtttgtttgttttgctaaaaggcaaaattttagtccaaggttagtttttcatgttattacatgttctttaaaactatgcttgtctgtccatattataatggcagtttaagatttcacaacaggaatatatcatcatttatttagagaatgtgggattgattagacatttttattcttttcaaaagtaagatctccagtcagttaaaactctactcctaaattcatccattatactttttggaaatgttttgtccttgttttatccatttcctcctccctgagaaaagcattctgcattgaaattttacactcaatttggtttgagaactgtgctttgcttttcttaattggatcatctggggttgtaagcctgtctgtgtattagaactggacagggagctcgttaaaaataaagatcgttaggcttaaattagactaaatacctgggaatcttctttggatatctcaccatttgggaaccactgttcaaaaccttatctctggtattctaggtttccttaaagactgtgtgttgattggcttagtaggacataagatgagactcattggcgctcagccacagcctctttgtgttcatctgtttcgttttttggggacttccacctaagatgctgtttcaaagaagttttatgctagaagcaaatgtgtttaccatggatattgtttatcagagctccgcttccagtgtataatggatggatttctttagtttccttgaacatggagaagcctgaagcaaactgtatgagataggagtcatggcttgtagaagcttacataaaacctttaaggctgggcacggtggcttacgcctgtaatcccagcactttgggaagctgaggtgggcagatcacttgaggtcaggagttcaagaccagcctggccaatatggtgaaaccccgtctctactaaaaatacaaaaattagccaggcatggtggctcacacctgtaatcccagcactttgggaggccaaggtgggcagatcacccaaggtcaggggtttgagtccaacctggccaacatggtgaaaccccgtctctaccaaaaatacaaaaaagccgggcatcgtggtgcgcacctgtaatcccagctacttgggagactgaggcaggagaattgcttgaacctgcgacgtggaggttgcagtgagctgagatcccaccactgcacaccagcctgggcgatggagctagactctgtctcaaaaaaagaatttaagtttttaaaaaaccttccaatagaagtagttgaaaaatgatagttgctacttttacttggcagttcttctaatccatgaatatggaccatctatttatttaaatcatctttaatttctattaataatgcgtttataactttcagtgtatgagtattgcacttttattacatttattactaaattttttatgcttttaaatgtttttgtgcatggaattattttcttaattttgttttcagattattcattatatgtaatcataatttttttattttactcttgtatcctgcagttttaagttttctgacgattccttccttaggattttctacatattttgtaattacttcttcctttccagtcagttatgctttttatttttcttgcctgattacactggttagaatgtccagtacagttttgaataggaataatgagagtgtaaatcctttctttgtttctggtcttaaggagaaagcatcgtctttcaccattaattatggtgttaaatgtaggttttttgtaggtgccccttatcatgaatagttgttggattttgtcacgtgctttttctgtggagatacttagtagttctcaaatttggcacaaggaagcttttcatagttttttttttttttctgccagatagatggtaattttaggatcaactgtgcgttgcatatcatgtagccttaaatgagaaccacggcagataatttaataccatttgttgaacaaatattcatgaagtgcctgcaggatgcatttctaacaagttcatttgcttctgatgaatgttcaagatttggatctagtaggttagaggtcagagtttcagacccatgataacaaagttttgtttcctccatgaatttattttttaaatggttttaaatatttaagcatagagctataaacctaatactgagcccagttccagctttttctaaaataatagttttctttttgttaccatgagcagtatcattagcatggctcttcttgcaccttttttttttttttttttaagagacaaggtctctgtcatccatgctggagtacagtggcgtgatcatagctcactgcagccagaactcctgtgctcagttgtcttcccccctcagcctcccaaagtgctgggattacaggagtgagccaccatgcctggtcttctttcacatttttatcacccattactatgacagaacagtgccactcagagtagagtggcaatccaaatagctgttttttgtgctcaaatttaggtgattgagattataccaggtttccttttagaacagatttataaatagtaatacacaaagcaaattatttgcatgaatttgttggtgttcctctgattcttatgctctccattgtgaccatgtacattgcggtttcatggtatgatttgtatcttacaggtttgccccattattgaaattgtatgtagtcacagattgaaattgtatgtagtcacagtttaatttgttcatttcttctaattggctgtcttcaactgtgaaagcagctgaaattctgtggttaattgaaatcagtcaaggtagtgcagtttgatcaagagtgaatgttactgcatttgatttgacattaattttaattttcattcaacattttatttggcagagtagcattttagtggtttttgttttttggtttttgttgttttgttttttgttgtttttttttttttttaacagggtctggttctcttccccaggctggaatacagtggtgcaatcttgactcactgcaaccttcacctcccagactcaagccaactcccacctcagcctcccgagtagctgggactacaggcgcctgccaccatgcctggctaatttttgtattttttgtagagacagggtttcgctctgttgcccaagctggtcttgaattcctgagcttaagcgacccgcccgctcggcctcccaaagtgttgggattataggtgtaagaccacacctggctgtatgttagtattcttacaacaaaatgtaatcagttgtatggtatttttgctaaatcaactttgtaagcctacttataacagaaatgtccacattattgtgggctattctttgccagacaaattgatggcaaattcataggtatctaatgtcactgcttaattcctgccgtttcaaaaagacagcaaataagcaaaaccacagcattaattcttcatgtaatttaagaaaaatagtgtttctctaactccattaatcatttaaatcccatatggttctcttacagcagtgtgatctagctgcatttcttcactgttaagaactgttaggcgcttctgttggagatagtttctaatgttgaaattatcagtgaatgttcattaattcttcatgttgaagctgtcaccatggaaacttaggtgttatagcaactagttatatgctataacttacttagcattaagatgattaaataacatactatatgtaaagcagttggaagaatcatggaaagcaatgtcatttcttagcagatactactatcattttattcttgttttttggcaagtgtgaaaattaaattcaaatattctttaagatgtatacttctggtcttgagatgtaacatcactttgtgatcttacctaagtcctctgctctgtaggaattacaattgtttacataaagatgctattactatctttggtatgaaactcaaatatttatcaatagatttaccatgatgttttgaaaatcagtgggattggggacagtgacatgtcaaaatcatctaggaattaaaaaagaaaagcacaacactgcttatttaaacactgctggtctacaagtttagcttcttttggacttaaaaaatttgttagcttacccttgttttatgataataacaataactcagcatttgtttgataatgagttaatatataatgaaaaaatttcatgactaaatagttggatgtttttactatattgtttgatctccagttaatgtgacaggtgaaggagtttggttgggtgttgctcttgtattttaacccttttataagatttcagttgacagtgaaattttaaacatggaactgtaatatgtaatataggtagtatttattaccatatatttacttaataaattcatatttacatttgtttattatataaatctaaacaggcagttttgagtagtgcaaacattttgataacattaatctcagcatctttttttccctctattttgttatacagtattgagaaaaatccaatttaaacagattagtaattgaaaactgttttaaagcttgcctgatagccttaaattgtcattctagcaggtagaaagaatagtaaggactttggacttgactcgccaaatatctaaccttggcttgcatttattaattgttgaaaatgagctttgtagtcagacatgattcccatttctgctagctgtgacaccatggataaattatgtgactcctccaagccttgagtttctctcatttatcaaatggacgttataatactttttacctcgtaagaggtagatcatatttggattaagtaaggtaattacatgtgttaaagtatatccaaataatcatatttggattaagtaaggcgattacgcttgttaaggtatgattttcaaaaaagcaaagttcttaggcaaatgtagaatgaacatgtgtcacagattgtattccactcacttgttaatgagagaaatagtaagatgttaaacttgaccagagtgcatttgttatctaagtatttataggcaatgttaatagaagattgctgagttagataagaaactgattaatatccaacgaggccaggaatttaatctttgtggttatctgggcaaaaattatttgcttctctattgaataaaaagctacaggttaacatatataacttcactgtctaggacttttttttttttttttttttaagagacaggctgtcactctgtcacccaggctggagtgcagtggctcaatcatagctcaagcagtggctcaagggctcaagtgatc

SEQ ID NO: 473 - DNA, 658 bp, Homo sapiens
  misc_feature (467)..(467): n is a, c, g, or t
  misc_feature (474)..(474): n is a, c, g, or t
  misc_feature (498)..(498): n is a, c, g, or t
attttaaaaactaaatatattttttcaatgccatcccttgacctgctttaccttaaccatgaataacagtgtatgccactcaagcccacagtggagactgaggccatcttagtaaagcacagaggagcctgggggagctccccgtctatccctggttcagttccaggggtgcaggcaatgtttggaagcccttagcagcagcatcactgtgggagctgccactgtctccatccacagacaaaatctgctccaagggatggacaaggagcactgttaggaccctacccagccttaccctcagcccacagggccacctgcttctgtcactcttactaggattcgccaaaaaagcgggggagtggtagggttttaaccagaacacaaagtggtagttcctcctagctgtaggagggtgggctgtcctgcaccagtgtctgcatgggctcctgcccactgggggggctcangccccangagtcccggcctggcccataaggngggtgctgccctcctgagggtcaactggagtctggctggtgtggaccacgacagtcttctcatccacaatctcacaggtggggttggtgaaagcagacaagggcagagtgattcgctgcatctccctctcacatactttctgatcatgctgttctttcaa

SEQ ID NO: 474 - DNA, 592 bp, Homo sapiens
  misc_feature (155)..(155): n is a, c, g, or t
  misc_feature (159)..(159): n is a, c, g, or t
  misc_feature (170)..(170): n is a, c, g, or t
  misc_feature (242)..(242): n is a, c, g, or t
  misc_feature (267)..(267): n is a, c, g, or t
  misc_feature (273)..(273): n is a, c, g, or t
  misc_feature (453)..(453): n is a, c, g, or t
  misc_feature (509)..(509): n is a, c, g, or t
  misc_feature (520)..(520): n is a, c, g, or t
  misc_feature (547)..(547): n is a, c, g, or t
aagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtcccccncggnctcgcgcgacnctggccgaagccgtggtggcagccccgggaggagcactggcgtctgtttccttcgattctcgggattcgaanatggctgaaaagttagcgccgaaanttttgntaaaaagcaccaccaagatgtctctaaatgaagcgctttactaatattgctgaagaacaaacagccgacgccattgaaatatttcggggcttcgattgcagcaacaacagcagctagccagttgccagaaacagaagacttgggccagcagatggaggattagaacctctgttccagggnagcattaaaatttaagcagagctttaaagcagcgcctgggttaagaattaaattcngggcacggttntggccgacccataaggggccttgccanggggagcaattcggagggacgaggcctacccataattccagagag

SEQ ID NO: 475 - DNA, 2576 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaaggaaaaaaaaaaaaaaaaaa

SEQ ID NO: 476 - DNA, 532 bp, Homo sapiens
tttttgagacagtctcactctgttgcccaggctggagtgcagtgacaccattttggctcactgcaacctccgcctcctgggttcaagcgattctcctgcttcagcctcccaagtaactgggattacaggcgcatgctaccatgcccggctaatttttgtatttttagtagagacggagtttcaccatgttggccaggctggtctcgaactcctgacttcaggtgatccgcccaccttagcctcccaaagtgctaggattacagaagtgctcggcctcaaaaattttgaaaagaaacttagttgtcaacatgatttcataatagactgcatacttagtgttacgctttcccattcaattaaaagtaataatagtctgaaaaaaaataattgtataaaggaaagtctactttcagatatggttagctttcaacctattaagttctggattttggtaagctgaagtaccctttcatgtgtccgcagaggccatctcattttagaggtgactatgctcaaactcaactcgccctag

SEQ ID NO: 477 - DNA, 2978 bp, Homo sapiens
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagccaaaaaaaaaaaaaaaaaaaaaa

SEQ ID NO: 478 - DNA, 1235 bp, Homo sapiens
ctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcatttttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatct

SEQ ID NO: 479 - DNA, 1680 bp, Homo sapiens
ggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgatgcgtggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggac

SEQ ID NO: 480 - DNA, 699 bp, Homo sapiens
atgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaactcatctttctccctaattcatcccaggacaagcctaggaaaccctggtgttacctccaagaggaaagacatacacatcaaatgcagcggtatgctgataaatgttacccctggatccccagaaaataaataaagtcccaatttatagaaaaaaaaaaaaaaaaaaa

SEQ ID NO: 481 - DNA, 2389 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccagccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggcgaaggagctccagagcctggcagtggcacagcgggaccacatgcttcgcgggatgcccttaagcctggctgagaaacgcagcctgcggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggtgtgtggccgcacatgaaaacatcatttggtgctggagctgatactggttgtttagctccgggtgtatccaaacctacttaggatgaggccggtgtgaccaagcccctggtgggggccctggggtgcatcttctgtcccctgtacccgcccctcagcctttgcaccccgccctccgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggtgagggggtcctgggcggactgggtggtgagtgttctccccttagtggccgggacgtgtggccgggaggttctcaggcctggacctttcccatcagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggtgagtggatcacctgaggtcaggagtttgagaccagcctggccagcatggcaaaaccccgtctctactaaaaatacaaaaattagcagggcgtggtggcgcacaccagtagtcccagctactcgggaggcagaggcatgagaatcgcttgaacctgggaagcggaggttgtagtgagctgagactgcgcctctgcactccagcccgggcgacagagcaagactgtgttgcc

SEQ ID NO: 482 - DNA, 3923 bp, Homo sapiens
ctcctccgctccctgcgctcccgccacctcggcaactccgcgcccgcctcccgcctctgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgagggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 483 - DNA, 525 bp, Homo sapiens
gccatgggttccccttcagcctgtccatacagagtgtgcattccctggcaggggctcctgctcacagcctcgcttttaaccttctggaacctgccaaacagtgcccagaccaatattgatggtgtgccgttcaatgtcgcagaagggaaggaggtccttctagtagtccataatgagtcccagaatctttatggctacaactggtacaaagggcaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggaatctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatagcag

SEQ ID NO: 484 - DNA, 941 bp, Homo sapiens
tctttttggcttgagcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggat

SEQ ID NO: 485 - DNA, 3414 bp, Homo sapiens
atgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaccgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctga

SEQ ID NO: 486 - DNA, 6668 bp, Homo sapiens
aggctggcgtccccgccccgaaagcactgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaactagagatacttcacagaataacagggaaagttccctgtgctcatggagcttacattctacagggagaaagagatagccaatacataggaataaatatatacaaggtatcatgtagtgataattgctgtggagaaaaataaagcaggggagggagtaagaaatcctggagatgaggctgcagttttaaatggggcctcactgggaatgtgacgttgagcagagacgttagggaagtggatcctggacaaggcattccaggcagaggaacaggatgtgcactgccccaaagtgagaacttgctctacgtggtcaggaaagagcagggagaccaagcagagtcgtgggcaggggtagaatggaaggagaggcggctggggaggacaggtggtggagggccttggcttctgctaagtgagatgggaaccactggagggtttgaacagaggagtgccttgattgatttatattttgcaagggtcattctagctgccatattgtgaaaaactttagtggacaagggcagaaggaagagggaagacctgttaggaagctactgcaaggttccaggcttgggcctgggccacagcaacagcagtggtcaaatatctagatttattttgaaaagagccaataggatttgctgagagtttgaatgtggagtgtaagagaaggaagagttaatgatgacattaaggtttttggcctgaatagcaggaaagatggagttaccagttactgaaatagggaaggatgggctgggtaagtatggaatttggtgcaaagcaggctgtctgtggttggaatgggaggttctggctgcaaatcaaagtggagagttctctcaggtcaggtctgcagcagagctcgagacagggatctgaatgcacttggtttattgttgggggtgctctcagaaggaacctgtgaaagcctttatcagtcatttattggctgtgagaagttctctgggagtgtgggtacatttgaaggcaagtgacttcagttgagggcaagtctctggaaaagaggctgtaggcatctggcagctaccatgcatggtagtgtgttgggggtgggggtcctgggcactggctgtgtgaagggatctggcagggcaccacagcgccccctactgaaccatcagcatgtcagtggcatttaaagccatgcagctggaggggccactgagattgtctctgagtattactgagaagcaacagaaaagagccatggatggagcccttgggctctctgggaaatgggaaatcagccaaaggactgagaaggagttaccttaaggtcagagaaaaccaagagagtgtggtgttctggaagctgagctttctttattcaacctcattcccttctccaaataagccacttgtgtagttgggcccctccagggttgaaggcaagaggagaaaggcacagcgtttgggaaacaagacttttcctgcaatagcctgggaaggaataaaaggatagagtgtttgggtttttgtgtaatggtggttaattggggtggaacactcacacgttgtgctttttctgggcttcccttatcccccagaacactctaccaacctcggggaactcgggcacatccttctgtttctccttcagctctatcctgctttcctcatcccttctgacaccacgtcctcactcacctgcacaagaatccctgcatcaggttctcctttgagggtacccacccaggacagtcccctaccacttctgtcttgggctgaagttgcccacgtccacaaaatctgtactcccagcgggggtgtttggcccgaggagtcagtgttattactggtggatgcaccgtgtccacagcagcccccaatcccagcgatgcgtcagatcttacgtggcttcctgctgggggagatggccttcacccacgggatgccgggttctcctttctttcctcaccccaacctttactccaccagagaaacttccttttgaactcagtggggaagagggtgatgagacaggactagaaagtagtgggggacccagcgagtggacgccctgctccgggattcctgagtctgtaaatagtgtgcccagcagctgtgaactccccttatagcctcaggctgcagtgtccttcccagctgtgtgagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccctgagtgtgcttcttggaagagcctagaagattcctggatggagaccccattggttcagcctcaagtctggcccgtcttcgaaaaaacaaacacatttgtaagctttgtgggagcttccaggcctgctctaagatgccttgcttgtcctttgacccatcagcatggagctcagtggttgctgtttggttctgcaggctggtggggaggccgcccatcgtggtggggcatctgtccagccccattgccactcagggcatccaaacaggaggcacccgctgggaagggtctaaagatactccttgtggccactgctactgttcacacttgacttgtggagaagcgaagggctgaggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagattgtcagttggaaggggtttattatgactgctggtgaaataaacagtgaccagtttctgccaacatttatggaaataacgtttctaggttttaaatgtgagccgtaaactgaagctacttcagttaaaaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtacaagggaggaaagaaaaaaaggaaaggaaccttaagtaagcctcagccaaaggttttatgcattggacttcctgtgcctgcccccaggggcaagactgatccccatgcctgtgcccatgacatctccctgaaagaggacaccatgacagcccggctttgccttgactgacccactgctaccccagaaataagaatcaagagcagctattgttatccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcagccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgcttaaaaaaaaaaaaaaaaaa

SEQ ID NO: 487 - DNA, 1233 bp, Homo sapiens
atgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaa

SEQ ID NO: 488 - DNA, 605 bp, Homo sapiens
cccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcacggagcaagggtatatgagagcgggtctcctcgtacaggaagtagaagatgttttgtttgggggcctcatcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccatgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattacaaaaaaaaaaaacaca

SEQ ID NO: 489 - DNA, 1700 bp, Homo sapiens
gcgggcgcggactgaggctgcgcgccgcaggttccggctgctggcggcgttgcggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaagccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtggaaaaaaaaaaaaaaaaaaa

SEQ ID NO: 490 - DNA, 666 bp, Homo sapiens
  misc_feature (597)..(597): n is a, c, g, or t
gcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgcagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttccctgagaccgacttcatcgacgtcactgcctaccagaantgacagatcacacagcctgagatcgaccacaacccgtctgccaaggggctccgggacaccgggaacggc

SEQ ID NO: 491 - DNA, 669 bp, Homo sapiens
agaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccaccttggtgggggcttggcattaatatggaaggctccatgttgacaatcagctttggaagttggatggaactacctggacttaaatttaaggactgggtatcaagtaaacgatagagcctaaaaagggatcgagttatgccagatgaaatagctcgctactataaacattatgtaaaagtcatgggtccttcagaagaattc

SEQ ID NO: 492 - DNA, 1309 bp, Homo sapiens
tagagacagggtttcgccatgttgcctaggctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggagttcagtggcatgaccagggctcactgcaaccttgatctgggctcaagtgatcctcctacctcagcttcctgagtagctaggaccacaggtgtgcaccaaccaaacccgactaatttttgtagagatgagatcccactatgttacccaggctggtcttgaactcctgggctcaggtgatcatcctgccttggcttcccaaagtactgggattataggcttgagccaccgtgcctggcctgtgatcagaattctcatttttttagtcactaaaaatgctgggggggcactccattctccattatgtgattagttcacattgcatgcttgtatcaaaacatcatatataccccacaaatatatacaaaaaactttaaaattttaagtattaattgctcaggaaaaaattaaaatgctggggtgctgaaatctcaagggccccattacaaaactccttaggaacctcgccctctctctgctgtaaggactggttccagaatgagagaatttaaaagacattccccgcccaaaatgttcataatgtcaccccggaaacctgcgaatatgttatattacatgaccagggagaagtaaggttgcagatggcagtaaggttgctaatgggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataaacttgtcttgttttcagccacgaaaaaaaaaaaaaaaaaaaa

SEQ ID NO: 493 - DNA, 1665 bp, Homo sapiens
tgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttctactgttttgccgcaccaggcttttttttttttttttttttagtttagtttttgtagagacaagatcttgctatgttgcccaggctggtctcaaacacctaacctcaagcaatcctcccgcctcggcctcccaaaatgctgggaccacaggcatcagctactgctcctggccctccctttttttttttttttttttttttgagatggaatcttgctctgttgcccaggctggagtgcagtggcaccatctcagctcactacagcctccacctcctgggttcaagcaattctgcctcagcctcccaagtacctgggactacaggtgcacgccaccacacccagctaatttttgtatttttagtagagatggggtttcaccatgttggccaagatggtcttgatctcctgacctcatgatctgcccacctcggcctcccaaagtgctgggattacaggcatgaaccactgcacccagctttccagccctccctttctactcttatctccagccaccctccttcaaaggtctggcagcataacctctctatgccccagctgtgtctttgctcatattggccctctggaaatgatttcccccttttttttaagtgctccagtttttcccaccttatccatcccatgtcatcttccctctgtgtggtccttgcttcccattctagctaactcttatccctcccccatactcctggagccctctgccctcagagtcttttgtgtcacacagacccaataattagaactgtttggtctctggctagactgtgagctccttgcaggtggggaagatgtcatgtatgcttttaccctccacccaaatgcccagcacaggaggaccaggattggaacaagtgttgacctctcatgtttactttgtttcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgagggccagtagtgggaacacggtggtgctgggggacaagcaggctcctgttgagctggagcacctctgggcacagaagttttattttcctggcattcccaacaagtgttccctggggattcagctcatggtcactgttgaaagccttcattcagtccccctttctctagccagggctgcctggacccctggatgccctgattaccatccttaattctccctactaggtgcatataattggccacattcccccagggcactgtctgaagagctggagctggaattattaccgaattgtag

SEQ ID NO: 494 - DNA, 2808 bp, Homo sapiens
ctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttggattggcaaaaaaaaaaaaaaaaaa

SEQ ID NO: 495 - DNA, 2209 bp, Homo sapiens
ggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatatgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcaaaaaaaaaaaaaaaaaaa

SEQ ID NO: 496 - DNA, 845 bp, Homo sapiens
  misc_feature (749)..(749): n is a, c, g, or t
  misc_feature (786)..(786): n is a, c, g, or t
  misc_feature (822)..(822): n is a, c, g, or t
tatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttccttcaggacgtgctgcgcgttcaagccagtcttcaaaaaagccgtcattagtattattgagcacctgtcagtggtattcccatgttacaacagcactgagcttgctgggtttattaaaaaagtgccaacaaaaccaggaactcactctcanggattgagtattgatgaaattgtccaaagagtggccngaacacattctagatgaaccggaaaaaggaaaaagnccaagccccaggaaaagggccag

SEQ ID NO: 497 - DNA, 630 bp, Homo sapiens
gaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgtcttgtgaagaataaaagctgatacaaatggcattactgcttttttggggcttcttatataagtgtcaggtgggtgcaagtgaaccttttcaccatgtgcccatggaagctctcaaactgaacattttccgaggaac

SEQ ID NO: 498 - DNA, 779 bp, Homo sapiens
tgatgcggcctgggtcagactcaagtcagatacaaccctgattttgaccttgcccttggcaggccccacatcctcttattcctacatccctttctcccttccctcctctgctcctcaagtaagaggtgcagagatgaggtccttctggactaacaagccaaaaaagagaaagaaaaaaataatttattcttttctgttgtattgtgcgtaagttaagaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagctgacggccagtaaagtggacttaactcccaaggtgtgtcgcgccggacaccgggccctggacatgctgcttccatgtgcagtcccttccctgcttctcgctgtctgtccttgttcccacctcccagccccgcaggttgcagagttgttgtctgcagtccagtgtgggtagagcgatcggtgtacggggttcctgcgctccttgtctcttctcccaaatcttttcccttcaaggaaacaaatatgttcagaggtcctgtcttctgtccccatctttctggcgatagtatccgctgtatgatgtggatgccctcactgctgagttccagcctttttggacctccgtgcggggagaggcagaagggacgggctccagatgctccacttttccacgccttgggggctcaga

SEQ ID NO: 499 - DNA, 1011 bp, Homo sapiens
ccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggtaaaaaaaaaaaaaaaaaaaaaaaaaaaaaaaaa

SEQ ID NO: 500 - DNA, 765 bp, Homo sapiens
  misc_feature (4)..(4): n is a, c, g, or t
  misc_feature (7)..(7): n is a, c, g, or t
  misc_feature (9)..(9): n is a, c, g, or t
  misc_feature (42)..(42): n is a, c, g, or t
  misc_feature (48)..(48): n is a, c, g, or t
ctgnttngnaaaaaaaattgccaaaaaaaagttgtgcacgcngtactntaagctgggagtcctctagagcggccgcccttttttttttttttttttttttgatattgtagacctttattttctttaaatctcctaataaaaacattaaactttcaagaagattccaaactgacattgcatagaccaactcctttccaaaaatatctctgatatactctccaactctctcaatatatagaatttgaagtccaggagctgtgggcacctggtgggaattcactgagctcaaggggacaagagggctgaggacagggctcccacatggggacaaggccaggctttctggcctctggttccagccagcatcaatttggttgtggccaaattctcagtccaatcaccctggcccagggcctggcgtgggaggatgtggcaggctctgtctccttctggggttcctggtctggaggagtctccccaacagcgccaaagctggctgttttccgcccaaagccccagaactttgaatgagaggcaaatctaccctgaatgcacctccctcctaggctgggtgaggtcacgcagacacagaagggcaggacagaactccccatcttctgggggccaattcgtctggacactgtgcggtcagcttcctttttaaagtgccagtatcggtggggcaggaagggactctcagggctgagcagagccttctcagcgcgagcaaacactctgtcccgcctcggcaggcaccttctaaca

SEQ ID NO: 501 - DNA, 396 bp, Homo sapiens
  misc_feature (365)..(365): n is a, c, g, or t
caccatatcagccaggctaatctttaactcctgacctcattagccacccgcctcggcctcccaaaagcgctgggactacaggcatgagcaccacacccagcccgtggtcagaccttccagagggggttcaggtggaaggcagactcagaattttcgcgcacccatgcctcgcgcttctcctgaatggctgaggagtggagggctgggggtggggcccaatttaacccatgttttaacaaaccctactctaaaactgcctgacatgtcacaaggaccaccggcatcacagggccagttcccctcactgggatggcccacactgggtggtaaacttaggaagagggctggggcacactggggttcantggctggtaatcccaggggctttgggaaggg

SEQ ID NO: 502 - DNA, 1548 bp, Homo sapiens
gcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaa

SEQ ID NO: 503 - DNA, 4963 bp, Homo sapiens
agcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttgcactcctcgggcgcccggcccccggccccggctataccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagtttcccttgcccagcatccctgcctggactggtcctgagattcctgaatcaggtccttcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacgctgctggctccgagtgcgaggatgtggatgagtgtgagaaccacctcgcatgccctgggcaggagtgtgtgaactcgcccggctccttccagtgcagggcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcatgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggccgaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccaggatttgcacccacgcaccagccacaccactgtgcgcccgcacgaccccgggcctgagccctggcacccgatggccacccacccgcgcccgccactcggggcccctgccccgcatcctgcagcccgcttagtctgatgacgaggaagcccgccagaaagtccagaagaaggaacgacggacgcaaagcggcgccgcctaccatgcctcccccccccaccaccaccccccccaactgtggtcgtccccgcccggcccaccccgcccccatttctccccccttctttcaataaaaatttcaatcataaaaaaccacctataaaaaaaaaaa

SEQ ID NO: 504 - DNA, 1844 bp, Homo sapiens
ctctcgagtctccgccagatccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccactgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccatagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgtaaaaaaaaaaaaaaaaaaa

SEQ ID NO: 505 - DNA, 2273 bp, Homo sapiens
aagcgggtaacagattctcggtcattctggggtcaagacgagctatcccggtccgaatcgcagtcctctggtctcatcagcttcctggtttgtagaggatgaaccctggcacagagaaggacagccacttaccccgggccgcacagccaagtagaaatgtcaggcggccaagagtcaagacgcaaaggacagggagctggtggcgggggtggtgctctggaggctggccctgcccccagctgatgcctcaggctcagcatctcgagaaagtcctgccccctggcttggtgcttcctcgtggccctgagtcctggggaaagtccagggcagggagtatgggtacttgttcttcctctttagggctggccaggggccaggggagctgtgtttgctcagggtggaacctgacaccctttggaatggattgaggttagcggaagcctaggctggggggaggggtcgcccagggagcgaacgggcatttattgtgcacttactgtatgcgcgagtgtggggtcaccaggccttggagattcagcagtgagcaaggcaggccaagcttcctgctctcgtggggcgcatattttggtggggaaagacagacatgaaacaagagcgcagtaatggagccaatggctgcacagagggtaacatgcgtgagaggcgctttgtaactttattttactttttatatttttttgaaacggagtctcgctctgtcgcccaggctggagtgcggtggcgcgatctcggctcactgcaagctccgcctcccgggttcacgccatactcctgcctcagcctcccgagtagctgggactacaggcgcccgccaccacgcccagctaatttttgtatttttagtagagacagggtttcgccatattggtcaggctggtctcgaactcctgatctcaggtgattcgcacgcctgtaatcccagcactttgggaggccgagacgggcggattacgaggtcaggagttcaagaccagcctggctaacatggtgaaaccctgtcctactaaaagtacaaaaaaaaaaaaaaaaaagaaaggtgctttatgtgtctacttaattcattaattaatatgggaaccggtaagactttatagcctatacagaggggaattaatttgtttcctttctttcttttttttaaaaattgaaaatagaaatggggttttgctgtgttggccggcctggtctcgagcttctgggttcaagtgatctgcccgcctcggccactcaaagtgctgggatttcaagcgagagccaccgacccggcctcagcattcttgattgcctgtgtgtgtgtgttctttcagttctcctctggaccagacacggtggctcacgcctgtaatcccagcattttgggaggccaaggcaggtgggtcacttgagcccaggagtttgagaccagcctggcaaacgtggtgaaactctgtctctactaaaaatacaaaaattagccaggtgtgttggcgtgtgcctataattccagctacttgggaggctgaggcaggagaattgcttgaacctgggaggcagaggttgcagtgagccgggatcgcaccactgcactccagccccagagacagagcaagactccatctcaaaaatgtcattccgtgcccagaatgacagcaccttagcgtagatggtttccatggggcagggggccccctctagccctgggacactgtaattcacctttggctttcccactgggggcccgagtggagttagaagcatggagaggcagcccaggggatccttagtggcagatgcttaaacctttgagccttccctgaaatactgctcagggtcaaaaccgggatccccgttttacagatgaggaagctgaggcaggggctggaattcacatgggctctgcttttctctctctgctgtggaacttcctcctagagctcagccgtcctcccttttgggggaaatggcatctttggcatggcttggtggctcccgcctggaatcccaacattttgggaggccgaggtgggaggatcgcatgagcccagcagttcaagacaggtccgggcaacatagcgagataccatctctacaaaatatacaaaaatctgctgggcagggtggcgtgcacctgtggccccagctacacaggaggctggggtgggaggatcgcttgagcccaggaaagtggaggttgcagtgagctatgattgcaccactgcactccagcctaggtgacagagcaagactctgtctcaaaaaaaaaaaaaaaaaaa

SEQ ID NO: 506 - DNA, 2759 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtcccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgctgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggaaaaaaaaaaaaaaaaaa

SEQ ID NO: 507 - DNA, 500 bp, Homo sapiens
ggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactccc

SEQ ID NO: 508 - DNA, 552 bp, Homo sapiens
  misc_feature (498)..(498): n is a, c, g, or t
  misc_feature (533)..(533): n is a, c, g, or t
  misc_feature (537)..(537): n is a, c, g, or t
  misc_feature (541)..(541): n is a, c, g, or t
gagatggagtcttgctctgttgcccaacctggagtgcagtgttatgattttggctcactgcaacctctaccatgttcaagcgattctcccacctctgcctcccgtgtagctgggatcacaggcacacgccaccacacctagctactttttgtatttttagtagaaatggggtttcaccatgttggccaggatggtcccgaactcctgacctcaagtgatcctcctgcctcggccttccaaagtgctgggattacaggtgtgagccactgtgcctggccaaaaatgtgatttcttatttcccacattgccaattccatttcaattaactataatagctatgtctattgagcactcaagcgtattctagaaactgttcctgattctggggatatatccatgaatgaactatagtccctgttattaagtaatccgtagtctgactaaaccattagaaattaaaaaaaaaatggctactttcaaagacatcttggagttcangagtcccacactgggaaccattttacctaataatncaanctgnttggaattaac

SEQ ID NO: 509 - DNA, 2490 bp, Homo sapiens
ggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcaggctgaccgtgctgaagtgagtcgctttgccaagaactttctgccgatcctcttcaacctgtatgggcagcccgtggcagccggggacactccagcccctcgccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggcccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattggggagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggagatctgtgctgttctggctgctgtcactgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 510 - DNA, 2411 bp, Homo sapiens
tctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttcactgaagattccgcctctcatttcttgagtcattttttttaaatttccttaaattggacttcacatttttctgatgcctccttgtttagcttaataactgaccttctgaattcttttttaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaaaaaa

SEQ ID NO: 511 - DNA, 1734 bp, Homo sapiens
ttcaccaccatccatgcgaccccaagagccttaatgactctagaagagactccaggcaggggaagctgaaaggacctttcactccctacttttggccagggccttctgatccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcagagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtg

SEQ ID NO: 512 - DNA, 2065 bp, Homo sapiens
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaaaaaaaaaaaaaaaaaa

SEQ ID NO: 513 - DNA, 2936 bp, Homo sapiens
cgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagcatctgtcttagtcactttgggctgctataacaaattaccatagatggagtgtcatagacaacaaacatttatttttcagtctggaggctaggaagtgcaagataaaggtgccagcagatatagtttctggttagggcccacttcctggtttgcagatggtcctcttcttgctgtatcctcacatagcaagagcagagaaaaaaagcgagcgctcatgtgtctttttataaggacactaatcctgttcatgagggcactacccttatgacctgattacctcccaaaggccccacctcctaatgtatcatattgcaggttaggatgtcaacacatgactctggggtgatacaaataggccattgcagcatatacaattaaaatgtaaatatgaagaaaaaaggaagtttttgtttttttgtgggggagatgggggttaaggaagaagatagtaatttcaggactaggcatggtagctcatgcctataattcctgcactttgggaggccaaggcaggaggatcacttgcggccaggagttcaggaccagcatggttaacagaggctaaggcaggaggattacttgagcccaagagtttgaggctgcagtgagctgtaatcatgccactgcactccagggtgacagagcaagaccctgtacctaaataataataataatttccacttcatttttcaatattcaaatatttttatataattctgcattgttctgtatgtagatcctaattttaaaattttacaccatcataaatgaacaaaggtaggaaggagtttggcttcaatagcttacagtaaaaggagtaaaggagttcagcctcaaaacgatattgttgacctgttatgttatgaaaaataatccagtgtttatacttaacggatgccatcccttattatttactattttcttagtctaactaaacaatctttattaaaataagcaatgatatttgacatgggcctaagaaatatatagttagctaacaatattgtcagttagagggatttcttttctaaattaagtacagatttcttcaccaaactccaggataacagaaaagaggacataaaatttggacatagtttctggataaataaatgtaaatttaaatataaattatgtaacaggaaacaaacgaaattaaagaaaataaatttttcaagaaaagtaaatttatggatgttaattctgtaacattgtcagggcaaagttttttgtttttattttaatttaagggttttatgtttgttttttacttgttgcaacctcaaatgaccaaatggtatgatgcacactgagatactcaataaatgtgcagtgattcttagccttttttcctagaactttaatattaacatggaaaattctgaaatggacaacaaaaagataacactttgtgtatggggaagaatatcatgcagttgatgacggtacattaaaattcacacaaaaggacattttgactagcattcagaaagagtccattgattataagattatctatgaggttttggaccgggcactacactaccgaattatggctaactttggtttgtgatctagaccaagtcacccaatctatcttggattttagttttctggtttatgaaattaaggagttaagctaaatgacttgggtttcttttcgtgtatcataatcaaaatgctgtaacttctctagtgaattcatagaacactgactcttacaagtatgtcatgaaatactttatgctgtgagcaggtatacatgtataatatatgtatagctatgaacaaataaattttaaataaatgcaaaaaaaaaaaaaaaaa

SEQ ID NO: 514 - DNA, 116207 bp, Homo sapiens
gatcttgtgagacttactcattaccatgagaacagcataggggaagccaccgtcatgattcaattacctcccaccgggtccctcgtacgacatatggatattatgggagctataattcaagatgagatttgggtggggacacagccaaaccatatcaccttccctgccctgtcttcttggaaaatcctttttcattctttaagagttaactccaataataacttcttggaaattgctctaacctcctcagacaaaataagacccaccctctcatgtgtttgcacagtagccgacagtttttttttttttccttgcagagtatagtgaaaagagaataggctttccaatatctactctctttcaaatcacaggagtagggcctgtacccagaaattgttgtttactaactgtagcatcttgggcaaattatctctacatgggatttaatgagacttcttaaaagcaatttgaccaaaatgttgatccattggcttctccactttaagactaaaaatgaaatcattcttgactgaataggtagaaagttatttatgttagaagttttttgtttgtttattttccagaagagatagctgcatttctattaagttttcaagacactcatcattcctgaatcctttctatctagccattcacattcctacctgtttttttgtttacaaatgttttcttctatttaacaaaatggatttacaatcatatttctcatagatttcttgctttgaaacactttaattagtactcattatttaccagacacaaaaaaagacagcaataagggccataaaatcaaagagaagtacatttctcaggaagtctaatggagggagactccaaatttttaatccaatggatgctagtggaatattaatgagcctagagggttgtgttaatattgatctagtcccataactcaatttcccatcccacctcatggcttataaaaattcaagacacatagtagttcttaattattctcttggagattttcttccaataaccaaagctatccccaggtcagagaaggattgctccaagaggtatttctcttaattcgccaaaggtagagattcgggggacaagtgagtcagtgtctatctccacatcatacctatgacttctgttttatgtaccagtgtttctcattaaatttcataattgaagcatactgatttttccctttagaatacatttggtaagatagtgagtgtctccatctaaaggtgggagtttcaaaaacacatcaaatgttttcttatatttactagctctgtaatctcataagcatgtggcagtatctcaagttgagacaagattatttcctctgtgttcagacatttatggaaaaggaatagcatagtggtagagaacatacattttagagtcactaagacctctattcaaattttacctctgtagctataatgcccaagagttcagtttacttctctgaacttcatcacacaaaagtctttaaagtatcggccgggtgtggttgctgacgcctataatcccagcactttgggaggccaaggtgggcggatcacctgaggtcgggagttcaagaccagcctgaccaacatggagaaaccccgtcactactaaaaacacaaaattagctgggtgtggtggcacatgcctgtaatcccatctacttgggaggctgaggcaggagaatttcttgaacccgggaggtggaggttgcggtgagctgagatcacatcattgtgctccagcctgggcaacaagagcaaaactcctccatctcaaaaaaaaaaaaaatctttaaagtatccacctacttcatattatattcaatgagggttatgttattgcactcaatgcatggcttcataataatgacagtagctaatatttattgggggttactactatgacctaatgtttggaaaacactggcctaactattccatgagaagtgagaaataagaaaggaacagaaatcccatctggaatgtgttgctgagcaaggttgttcaggagacacatggcataaatgctgcttgtatgagatataatttcagagtgagatattttaggattgtgggaaagaatatgggatagcctcagttttatagataagggctgattgaagctgctgaaaggcaaggtcaaaatatgaaaggagattaagccctgccctgtgccattgctccttggattgtgcacctctgttgagacttccctgaaagttaagtaaaccagtgtcatggtaggcaacattaagtaaccgattccttaagaaaagtgaattccagctgtctagtaacaggggctagggagagagtgattggcaatcaaggtcaggaacaggagtaagttgaaatcccgtcccttaggtgaattactgcgtatgtacagagtacagaaaaaagaaagcaaaagctaatatcctcaggataattggacatgggcgagacagaaggatgagcacatatctgatggaaaatcatttggccgcagattctcttctgaaacatcctgtgaagtaagtactgaaggcattggatcaaattctttcaagtgtgtacttagcatgaggctgctgctggctatgctgtttacagagtaaaccaagaacaaagtagccaatctcaggcctctgcctagtgcagagttttgcatttgaaatgtctagtaatgtatgaggcttggagaggatgtttgacagctagtgcttattgttttagaagggactcactctttcttgggtggtaggcagatctattaacttggaaggaatattccaattatgtcctttagttcaggctgctgctgtaagggttgaagatcagatagataagttacacagacgccaacttcagatttcattttggtagctggacttccctctgctagatggagatatcccctaggaagaatgaatgacaggcagtgaaaagaagatgcctaaagaaaacgtgagcattcacattggaaagagagttcagtatattgctagaaagtcttatgtagagagaagggaatgtattgagattgtagattcacaaataaacacacccaatgtctttctgcatttcagatattaagcttgaaacctcatataacaataaaggtcacaatttctgttttaaacaagtataccacctacgactaatctgagtcgtaggctaattaaaaaaaagcaagctagaaaagagtggcagagaaactcttcctctagacttcgtcttttgaccaaattcacaaccatttagaggcagatggaaaggtaaacaatgtctagtctcattttacacacaggtgacatggggcttaagtgagcacagcacagcagttatgagcatttatgaggcccaggagcctcatgcaaatcccaggtccaaacctcacaaactgtgtgagcttgggaatgccctatgagttttctgatctttgtctctcaggtgggtcaaatgagctagagtctgatgcagtgcctgacaggcaaaggtggcaggtgcctgtcgacagggatctagctgtcagtctttgtttcctcagcgaagcgctgcattctggagttcccgagtctgtgttctttcctctcccctgaacgtccaggaaccacaagcaactccccagcttccttcctgaggccaggttgaggcactgctgcttgtgccacagtcagcaagtgaccagggagcagtgctggatggcctctgcatgggagaataaccttgcccggcactggaatgcagggcttgaatgagccacagtggagcgcttaagtataaaaagagaggcaggtgagtctcggcaatctgaggcagaaactatccctagagagggagttagttgtccaagtcccatgagagaaaagtgacaatgtgcaggtgatagcatggcaaggtaacagtggggaggatagagggagggcagcagtgtattggggtgcaggacgtggtgggtgcatggagaagtgaggtttcaatccactccgcttcaaccacactggactccttactgtccctggatcatgccgggctcagtctctgattagggcctttgcactgcctgcttcttcatcctgggatcattcttccctatacatccatggcactgagcctctttcaagtcaaatgccaccttttcattgaggcctatacgggccaccctttttgttttgttttgtttctttttttttattttactttaagttctgggatacatgtacagaatgtgcaggtttgttttcatacacatacaacatacacacatgcatgtgtatataccaaagcagaatatgtcatcgtaaactttgatattccattgttagtaatgttaattgtgtcacaagaatgacatactccaataatttagaaccactgccattctctagtgcatagagaaacaaattaagcatgcacctctgttctctagaagctcatagtccaccgagggaaacacagacattaatattaaagccaatgcaagcaagaatgtactcagtgctacactagacctacaaacagagccctgtgaaaaaagaatagatgaatcctgactttaaacatctggaaagacttattggaggagataggattttaaccaggacttggtaaatgtgtaggaacttgaaaggtagatagatgatgttatcaacttctttgtatgcctgtcttactttccagtttggacaaaaggcatatctgaatttcaaggtcatggaaacatttttcattgagggaacactggactaaaggttcagacaggagtgattcagagatactgaaattggaatgatcaagtttccttacatattttttactttttttttctttgttgttgttgtttgttttgttcactttcccttagaattggacaggagccagggattctgagtggaagcactttctaggaatcaaaattgcacaggtggttggctttttattcgtcatgaacctcctggtgtttgaacataacaaatgggtacaggagcacaagaaacctcccaggagtttatatacatgagtttatgtctaaagatattgtaccttagattctctgtaagtaacaataaatgaatgtaatgtggtagaatcaaatagaaaaaacatgctgcccggtcaccctgtttgatgaaagctctggaagacctaaagatatttctgtgactagattacattacgggtcaaagaaatataactctaagattctacctatctattactataactgacaatgactaattatacccataactatttataattttatatatatatatatatatatatatatatatatatatatatatatccatgaggaaatacacccattgtcaataataattagtcaaatctatagctaatcaaaacctcaattcttgacttctgtgtactcacaggctcaataccacgtggaagctgccaaggcttgtggcttccaccctctgaagcaacagcccaagctgtaccttggcacattttagtcatggctggagtggctgagacacagggcacaaagtccataggctgtacaaagcatggggaccctgagcttggcccacgaaaccactttttactcccgagcctccaggcctgtgatggaaggggctgccatgaaacctctgacatgccctggagatctttccccattgtcctgaggattaacatttggctcctttttacttttgcaaatttctgcagccagcttggatttctcctcagaaatgggattttcttttttattgcaatatcaggctgcaaattttctgaacttttatgctctgcttcccttataaaattgaatgccttaacagcaccaaagtcacttcttgactgttttgctgcttagaaatttcttctgccagatgtcaaaaataatctctctaaagttcaaagttccacacatctctagggcaggggcagaatgccatagtgtctttgctaaaacataacgggagtcacctttgctccagttcccaacaagttcctcatctccatctgaaaccaactcagcctggactttattgtccatatcactatcagcattttgggcaaagccattcaacaagtctctaggaagttccaaactttcccacattttcctgtcttcttctgagccctccaaactgttccaacctctgcctgttatccagttccaaagtggcttccacattttcaggtatgttttcagcagcccccggctctactggtaccaatttactgtattagtccttattcacgctgctgataaagacatacttgagactgagcaatttatacagggtttaatggacttacagtttcatgtggcttgggaggcctcacaatcgtggtggaaggcaaggaggagaatcttatgtggatgacagcaggcaaagagagagcttgtgcaggagactcccatttttaaaaccatcagatctcgtgagacccattcgctatcacaagaacagcatgggaaagaccagcccccatgattcagtcatttcccactgggtccctcccacaacacatgagaattatgtgatctacaagatgagatttaggtggggacgcagagccaaaccacatcattgagcctctgtgacatgtagcagccctacagggaactgccaacaaaattagttttaaaaaggcttgtccaggaagcatacatgggagctggtcactttgctctttcagccctcatagaggtgcttagacctctggagagagacactgagacaggtaagagggcagaaatgactaagaggtaacacactgtggagtcccaaaaccagcacacgcttcagcccacaaaaagcctaggccacagctctgttcctccttttaagaaagaaaagtgggaaacaaataatctatgaatgaggagaaaacaaggagaatgttccccttttgggcaccctgttgcttttatggttctacctgctggaatttgtgttagatggaaataatgatctttgtgcacatttacaccaagaaaaaagagtcctaaggtcgacccacaaactatagagttcctaagttctctttttctctattttcttttctgcctgctttaaagctgctgttggctttctgcttagatacaatccactatttgcatccaaccatttcttcctgttactattttgcaaaccaatgagtttgtattaatatctcatgactagagttctgaagtaaaagctataggatctttggttgtatgagtatgtatgtgtgtgtttatgtatacatacatgtatttcattgcgttttggccagaaggtacaaatttggcttaaagagttgtcttggtcagttttcacactgctgtaaagaacttcactgaaactggataatttataaaggaaagaggtttaattgactcacagttccatatggctggggtggcctcaggaaaattgcaatcatagtagaaggtgaaaaggaaacaggcaccttcttcacaaggtggcaggagagagaagtgagagtgcgggaaaaaaatactgccacttttaaaaccatcagatctcctgataactcactatcatgagaatagcatgggggaatctgcccccatagtccaatcatctccctccaggtctctccctagacaaagaagattatgggtattataattcaaggtgagatttgggtggagacacaaggcctaaccatattgttccattcctagcccctcccaaatctcatgtcctcacatttcaaaacttatcatgccttcccaacagcccctcaaagtcttaactcattccagcattaacttaaaagtccaagtccaaaatctcatctgagacaagttccttccacctatgatcctgtaaaataaaaataaaaaaccagtaagttacatccaagaaacaaagggggtacaggcattgggtaaatgtttccattccaagtgggagaaatttgtcaaaacaaaggggtcacagacctcaaggaagtctgaaatccaacagggcagtcattaaatcttaaagctccaaaataattttctttgactccatgtcttacatatagggcatgctaatgcaaggggtagacttgcacagccttgagcagctctgtctctgtggctctgcatggtacagcctccatccctggctgctttcatggctggtgttgagtgtctgcagcttttcctagcacacggtgcaaatatcagtggatctaccattttggggtctggaagagggttgcccttttctcacagctctactaggcaatgctgctgtggggactctgtgtgggggctcaaacctcacatttcttttctgcaccaccctagaagagattctccatgagagctctgcctccgtagcagacttctgcctggagatccaggcgtgtccatatagcctctgatacctaggaagttctcgaacctcaattcttgtcttctgtgcacccgcaggctcaacactatatggaggccaccaaggcttggactttgcaccctctgaagcaattgacccaggtgtactttggcaccttttagccacagctggagctggaggggctaggatgcaggacaccaagtcacgaggctgcacagagcaggggggccctgggcttgactgacaaaaccatttttttcctcctatgcctcaatgcctgtggtaggagtggctgctgccaagacctctgacatgccctggagacattttccccattgtcttggcaatttacatttggctcctggttacttatgcaaatttctgcagcaggcttaaatttctccatagaaaataggtttttcttttctatcacataatcaggctgcaaacttttcaaacttttatgctctgcttccttttcgaacataagtcccaatttcagatcatgtctctcaagttctaagttccacaggtctctagggcaagggcaaaatgccaccagtctctttgctaaagcacaacaagagtgacctttgcttcggttctcgagaaattcctcatctcggtctgagactaccccagcctggactttattgtccacatcattatcagcattttagtcaaaaccattcaagaagtttataggaagttccaaactttcccacatcttcctatcttcttttgagccctccaaactgtttcaccctctgactgttatccagttccaatgtaacttccacatgttcaaattatcttttctttatagcagtaccccactctctgcagtaccaatttactttattagtcaattttcacactgctataaagaacttccctgagactgggtagtttatgaaggaaagaggtttaactgactcacagttccatatggctgaggaggcctcagaaaacttacaatcatggtgaaaggcataggggaagcaggcaccttcttctcaaggtggcaggagagagaagtgagagtacaggaaaaaactgtcacttttgaaatgactggatctcgtgagaattcactcactatcatgagaacagcatgggggaaaccatccccatgatccaataacttttctccctcagcccatcaggactgcagttcccttccttgacatgtgggtattacaattcgatgtgagatttgggtggggacacagggccaatccatatcaagagtactcataaattaaataataaacccagatgctcttcaagttcatgtgatgtaagtaaaagttttaataagctagccttaaaattattggtaaagtaatactagaaatgtctcaagaattttcagtatacatttttgtttgcatttattgttcaagcaatttcatactcattcctgccaaacactagaagtgtcaaaatttggcataagggatacaaaactatagaccaagcccaaaacagaaggatcttttcttgtataatttttgataaataagacattaatattggtttaatgaaaatagttaaatattgaattattctgtaaaacaaccatatatttaatcttaaggttgctacataggtaaacacctgaaattcacaggctttaaaatgggtgacaatgaagtaactgtaaccacccaatgagttcaccttgcccactgcctagaaagggctgatttatcaagacaggggaattataataaagaagagtaattcatgcagagccactatgcagtacacctgagttttattattactgaaatcagtatcctcgagaattttgggatcagagtttttatggacactttagtgctcaggggaccagtgaatcaggagttctgactggttgggtcagagatgaaatcatagaaaatagaaactatcctcctacactgattcaagaccagatgagccagatcattcattgatctgggaggtgccagtaggtcagtggagtgcagaatctgtaaaatatctcaagcactgatcttacattttagaatagtgatattatccccaagaacagtttggggagatttagaatctcacagcctccagaggcatagctcctaaaccatgatttctaatcttgtggctttaggcagtctagtccccaggcaggaagagggtttgtttttggaaaggacagttatcatctttgttttaaagcaaaactataaactaagttcctcccaaagttagttggacctatgcccagaaataaaaggacagcctcgtggttagaagcaagatagagtccattaggtcaaatttatttcactgtctcagttttgcatggcattttcataacataaataatgactattatagttttcataaacaatctaagctattaaaataattcagtaaatgtaatgggataaatacttgtagacaaacttgtcctcatttagaatctaaagtgatattaagttaaatcattgatatttcattacttggatattttccaataaaatatattgtagaaaaacatcgtttctagaagaatgtgtgtcctttttaaaaggtgaataactcttgtctaattcaaagcttatttaaaggttatatataaaacaaggtaaaaggaaccgagaagtaagagagatatagagaaaattatggaaataaagaagtatttttggtaagaaagcttaaagaaaaataattttatatgagaaagaatctcgtatggtaaattttgtcctaaaagaaaatgactggttgtttaagaaagagagatgttcaggacaaaccaaaaaatccaagcatgtcatgaatgatctgtataagtcataataagaacatttattaaaaatacttttatatgattgaattgtctagaattaaagggaaattataatggtctttctggagattgggtttgattaaaaaacttatgtgctaaagaattggttcaaactatgaaattttctaagatgttgctttgatcttaataaattaaaagacaatgtaatttttttaatgcaaagttcaacttttattaagtctcactattttcaactttctctcccattttaaaaggcctgaaagaaaaactctattttttaactcactttcagctcctggaatttttttcctttcacgttctaactgttgtggcctaatgctaaaaaacaaacaaacaaaaaaattatgtcttaaaaagtttaaagaaaatgtttccttccaacataatattctccatagggaacagcagtaacactgcagaagatcttttcttttgccttttggtaactggcctaataaacagatcttacactctatcaaaataattgcgatgttattactaagtttgacttgcttagaaataactgaaataaaaaaatacagaagtttattacatccatgtaactttctgtttgtgcttttaaagtctttgtgccattaagttacagggctttgactcctgagtctaaaaagtacattacgtcctgctaaatcttaaactgacagcagttaaagcctcatcttcagacccagtagaagatgccaatcaaaataaactgcattcatgagacacagggccagaaattaaagctattcaacttctgaaagcccagggactatcacggaagaggtgggttcatgagattgtaagggccaattttgagaaataaaataagttcagtttctctataaattaaccattaaggttgaaggcacaatgatgcaagacaaccatatggacttcagagtaatatggcctacgtcaattttccaggattgttctttctttgtttttgtttttctcccttcctccccttattttctctttataggacgtgagacttcacaccctgctaaaaatgagctttcctaacaatgtggggcctacctgtcaaggaaaaaaacatcttagccatgagagatcaggtgaaacctgagagcagagacacattttattctaaaatgctttctctgatagattttaaaaagaaaagaggggaaatgtgaaaggaaaataaatcttgggaccccaaaatcactaaggcaaagggaaaaatcaagcttggagctgcttaaggcaagcctgcctctgattctattcctaaaaaagatagctactaagatttttttaaaaaaggctacataccaccctcacagggaatttccatgtgtacaaaggacagacagacctcaaagttatccctctgctcactgagataaattcatatctggttgtctcctttggaaaggctaatcaaaaactcaaaggaatgtaaccatttatctcttacctatcaatggccagaaagccccctcaccgttttgagttgtcccacctttccagaaggaatcaatgtatatcttacatatatttgattgctgatgtctcatgtctgcctcaaatgtatgaaacgaagttgtgtcctgaccaccttgggcacaggtcattagtacctcctgaggctgtgtcacaagcacacatccttaacattagcaaaataaacttcctaaattgactgagaccttctcagatatttggggttcacagttccctcctccatcttcaacgccaacagtggtgagctgaatccctctcatgatgccatctctcagattctctttctttccttttagggacctatggaactacatggggtctaccagataatctgggataatttcctcatctcttatgattcttaaattaatcgcatctgcaattcctcttctgatatgtaacaacattcacaggctttggggattagggtgtggaaatatttgggtggacattattctgagtaccacaggttcttattaccttacagatgaaaaactggggctcaaagaaatttagcaatttgcccaagtggtaaatattgaggcttcaattcaatcctagtctggcctctagagatgctatagtaatcagttcaaggtgagggtacagtgagagaaccataattctgcccactgattctcattctccctctgttcctgattctctttgcaaccattaatagttatttaagtttccattagattttattgtatctcaccattacaactgaatgtgaatttcactctagcaggacttcaaggattttggtaagcacagaatgtttcctgaggaatattttcaattccaagcaggtctagacaggtacaaaacacctgtgcctgtttaggggattcagaatagattgccaccttcacaaatatctaaaagactaggaaaagaaaaacaggaacataggctctggctctgagtttgctgaagttctcagataacattatcagctttcttggtctttgacagtaccccaagatccatgtcagagcatgaaagcagaggacagaagtctagaaaacccttatctaatgcagtattttaaaaaatatgtattattctttacatgtgtctctctacttagtattcttcagagtcttttcaccagccaggttacaaactcttgagtgtcttctggaattaaaatatctgtgtattttagagcaataaaggaaaaactgaacagccatatctggaaacataatatttgcttaatgaaggttagtctttctctcagtctctggacagtcttctttgtgtctcaacagttgcatttcctggagggcagtcatcattataaattcaagtgacttttataaaaactcatttaagaacaaactcagaaattagtgcacatgtaattcatgtatttacttgaacacaagtagcataatgacgactagtgatgtataactccagagtccagtactacatagttgttagcaatttatacagttgaacaaatgtaagtagaaattaatcatacactatgcagataatctatcccaggcctccttttccacctttactatagggcttaagatgtgcagcctctcaaatccgaagacgtttaaatgatttaactgaatacctatttaagcccacagtagaaataaacctatttaaccctaaaagctggtggaggaactctagtaactatagttaacatatgtgttatggactacctgcatactgaagcatatgctttcaaaataattatctataaaacagatctgattttttcattggttgtcatgataccatcagtgaagcgttctctggggaaatgaaccaactggtgaatgatttctttggttttgttttatttgatgaggaaggcatggtcccaatctagtcctttattttttatttgcaatgtttttagaattggcaatattgcactaaaaattgcaacactacactaaaaaacatagtatatgcatccttcggcatcttctcttgcccctttctgtaagaaagggactaaaatttgtatcagtcattgtcgattcttgtattagcatgggaggaagaagaggttgaaataattgattgaataaatgattggctaaaatcaagtacagtatgtggatttcagctaactggttttttacctcatttaaatactctctgcaagataacctaatacctcccatatataagaattgcttgtgtaaaattgaaagccatatggaaaaatcattgatctatgtgtgttttattatgtaatattttcgtctaactataaaataaaatgtatgggagaaagcttgacacataaaatttcttttgaacataaaagcaagaaatatcaagaatgtttccctaatataaaggctttctgcttttgctttttatcttagaataatgatggaataaattgcagctagagaagtgaagatgaaagagaactaatccataagcgaggagttgtaacatcagaaggactgttgcagattaccctgacccctacagtctgccaaaggaaaatgcagtgcctggataagtgtcctgcatatattcatatgccaatttctcaataatgatttccccagattttaatactggtgtagaataaaatcccttttgtttttttattcaaatagagtcatgaaatattggaagtcacaattagcatgcaggataagttgatagctaaaataatcatagtattttagtttaaattcttccatttgaaaaagtatttagccctgaatcataaaaacttttaaagacatagagaaataggactgtggtggggtgaggggaggggggagggatagcattaggagatatacctaatgctaaatgacgagttaatgggtgcagcacaccaacatggcacatatatacatatgtaacaaacctgcacgttgtgcacatgtactctaaaacttaaagtataataataataataataataataataataaaagagaaatagaagccaagggctcctcacacttttccattatataatgcagctatcttttaaatttgctttcttcttaactagaaggtctagtatggcattcaatctgagaagtaatcggctttcttttcctaagctttttacaaaggaaaacctgtgaacaatggagtttcctaaagatggagttagtgagtgttcaacatatgttttttgataagtgaatgcactggtctaggctctgggataaaagctaagttcacaaatggatatactagcatagttttcatttttaaagaatgtatatgatagtggggagagaaggcacataagacataagcagataactgtaatttctaatgtttcaataaagacacaaggtagatgtctgcagcacagaggagaatttttttttctggagacggagtctcgctgtatttcccaggctggagtgcagtggtttgatctcggctcactgcaacctctgcctctcgggttccggttctcctgcctcagcctcccaagtagctgggagtacaggcatgccccaccacgcccggctaatttttgtatttttagtagagatggggtttcaccatattggccagacttgtttcaaactcctgacttcaaatgacccacccgcctaagcctcgcagagtgctgagattatgagcgtgagccaccgcgcctggttgagaagtacttattcttgatttaaactgaaaaatgagtggtttctaatgaaattaaagtaggtaacattgttaaggtatgttagaaatttgctattttcttttaaagtatctagttataagtagtctttctcttggtaaaagttgagtttaagagttgtaaaataaaactaagcatatgaattatattactattgctcttagttgacttctaaatagtatctatatcaagctaaacaggtatagcaagtgtatattgttgttgttgttgtttgatatgtgtatagatttgatttgtttttgtgagcactgttgaccccaactcattcaagtatccaatcacggtgattttattaatatactaatatatacttattaatatactcactggtgagctgactcatataactttccagccagaaaacagagtgacttgctttttttacactattttctttttactgtcttcgtttttctgttcatgtcctttgattcacatcttaccaccctggtaactcatgagatactcatcattatccaggaaaggatattctacttcctctcttccaaaatgctcaaagtttgagtgtcccagagcttagttctttattcacttctttttgctttctacactgactacctaggcgatttcagattcatagatttaactgttctttatatgctactgcctttcaaatttgacatatcttttgaacacatattcctatgtgcaatttcctacttgacatttcctcttgtcgaaaaatgaactctgagttatttcccccagtactgtttcttcaccttaataaatggcatcaccattcacccagtttctcaggacaaatgtgttgccatcctttatgactttcctcagcaccaccaccactatccagtgcatcagcaaattttgttggctctaacatcaaactatattccatagtatattatgttattcaagattataaacttattgtaaatgtatcatttctataaccatttctactgcctgctcactagtaggagcaaccatcctattttcccttgactattgtaataatccacactgaatactttattcatgttagttcagtctttggagtcaaggagttgtaagtctgatcattttaattgtgaaatgagtgctcaaggtggaatggaggccaagaaaattggaagtgagaaggtcaagtagctaagagtccagggtgtagtagtgtcatctgtatggattttgaaatagccaaattgatgataatcatatgattagagagcaacatagagaacaaggtgctgaaatctagaacatgaaatgagtgagagggaaaacccttggtcccatgtatttgcacttgctctacttccctcataactctcataacgctatacttgttcatgggttctttgcctttcagatttagctctttgttaatgacctcactccctgcattgttttcagttcacattcctcagaacaaggagcagatcagctctgtctattcatgtttaggtggtcattttttcagtgtgtggcaggccatatcacagtttgccctttgctcatgttcctacctctgatctgcttaactgtagccaaacagtgaaaaggaatgacagagcaaggataaagggatcatgactacctagcgttgtaccttcagcaaaaattagattgaggggtttatcttatacactaaagctttgaaagcactttagacacgacacacaataattgaaatctctatataatggggttgtgccagagactgtggtagtgaaacagcagagatgaggtgggcagtatggggaagtcattttataaattcctagcatacatgtactgtcatcttaattgaagaaaacaaaaaacctgataatgtatataattacatatatttaatatatgcatatatatacacacaaactatatacaatttttatttatcaaatgtgtgcccaaaaacgcttaaaataaaaagagagaaaagcaaactgagtatatacatgactttacttggtgcttgatgcatcctagatattaaaatgtgctttgattcctacttccattcaatcaccgagtgtttattacgcagtcactctctgctgggtatttgtatttgatgagtagtgagtccatgtaaggataattaggaattctgtggctctgggaccaaaaccttacttgctttctcaactcaggcaaagataactagatcctcactcattaagaaggatcagcaatgctatataaatgattcctcttactgcacttgcccttaatataaagtaaaaggatggatagcacacttacttcattggaaattagaaagattaattaagtcaggaagcagtgctttgaagacgaaagtgattcctgagtgttaaagtgctagataagtatccagcagttgcagggacgatgcagtctgcaatagtgtgccaggaattgaaggcacaccataatgctttagaattacaaaaggcatttgctgaaaattcaactgagacaatgaacagcttgatagccttgggtttctgataaagtatcattctgttttcaagtatatggtatccaacagaaaatacaaacatacgtcttaaggataaaatgagatttaagtggacaagatgaataaagtgtaaaaccccatcatggtgtatatcctaatgttcagaacatgcgtgaggaaaaagacctatattgcatcacctgatttgagtgatacaaactagaacaaaggagtttggaggcagagttgaatgcacatcaaagatgctccccagatctgagaaatttgataagataaaggttgaaaaatggagaacattgatttggaaaggtgccataaatatttcttgcgtgattgcaaggggtgggaaaataaatggaggaatgatacatgattgtacattgtttgctcatttatttttttgattgcctacttttaaaaatttatcctaagtgttatcacttgaattgtgcctccctctggaaaaaaacataaacaaataaataaaataaataaaataaaaaaagttgaagttccaaccctcagtagaatttcacctaaagttacctttgaatgtcactatatttgcgattgaaacttcccagatgatttagttgtgattaggtcattagggaagactctactctgatatgactggtgcccttctataaaagggaaaatttggacacagagacacacccacaaaagaagaatatcatgtgaacatgaaggcagaaatcaatgtgatgcctaatgatgtcagagatcaccggcaaccatcagcagctgggaaagaggcatggaacagatcccccctcacagccctcagaagggaaccaaccctgccaaccctttgccctccagcatctacccttcagaaccgtgaggcaacacatgtctgttgttttaagccatccagtttgtggtactttgttagggcagccctacaaaatgaggacgcctaggatagtgaaatatccaattaaatatacatatatacattttatttttcattcaaatgagtctgtgctcactggctgcatgtaggaaaactttctgtaaaagatgaatattttaggctttggtcttaggcacaagtattgaactctgctgttatcgtgcaagaacagttgggtagtaagtaaagaattggcatgaatgtgttccaacaaaataatatttatggacactgaaactggaattgtatgtaattttcaagtgtcatgaaatattatacttcttttgtttttcttaacaaatgagggatgtaaaaaccatttttagcttgtggacagatttggcctgtaagcgatagtttgctaacctttactataataggaagaagataggtttttgagtcaatgcgcctggtactatccctttcttgctgtgtaatttctgacgtgttacttcactgagtttggtttccatccttggaaaacagagataattttggtttacatatacacaatggaatattattcagccataaaaaatgaaatcctgtcatttgcaacaacatggatggagcaggaaagcattatgttaagcaaaataagccagggacagaaagacaaatatcacaagtgcttaaccatatatgagagattaaaaatagatctcatcgagatagaaggtagagtgatagttaccagaggctggaaagggtagtgtggagagggaatatgaggggatggttaatgggtacaaaaatacagttagatagaaggaataagatctaattttgatagctcaatagagtaactatagtttgcactaatttactgcattttcaaagtaactagtgaagtaaaaatggttgctcttaacataaaagaattataaatgcttgagatgatggatatcccaattaccctgatttgatcattacacattgtatgctcatatcaaaatttcacaagtagtccataaatatgtgccggtattatatagccacaaaaaataagtaagtaaataaataaataaataaataaattcacttttagcagggctggcttataagcacattatcttctaatttttttttatttttgtgggtatatagtaggtgcatatatttatgggttacatgaggtattttgatacaggcatgcaatgtgaaataagcacatcatggagaatggggtaaccatccccttgagcatttattctttgaatttttaaaaaatccaattgcactctttaaattattaaatatacaattaagttattattgactatagtaaccctattgtgctatcaaatagtaggtcttatttgtgggatctaaaaatcagaacaattaaacccatgaacatagatagtagaagaatcattaccagaatctgggaagcgtagtgggagtctgggaggagttaggaatggttaatgggcacattatctgagtaatcacacagggccctgcatttagaagggttcagcatttgatttaatactctactgtcattatcttgaaatgcttaataattttgaacaggtcctgtattttcatttcatactgaaccccgtgaattatgtacacaactctggctcctagcataaagtagaggccctaaaagaatagctattgttgtgactatgtgttgtagtgtgtaattaagtgtagatgaataaaaaggtaaatttttatcctcagttaaagaaccatgacttcactggtggacaataagaatacactctcataggacaaaagcactgatgactagcaagatagacatccttggaacagatgagcatactggcctgggaagtaaagacacagcgctctaattctgtaacatgacaaattagggaccaagaggaaatgctccagagacagccaatttatgtgggggacctaactgttctcttacaatgaaggtttgagctatgaaatcactttgagaatgtgctgactttgcaggggtatgtgcacagaatgttaaacaactccttgcagttgggtcttgcagcaatctttattttgagcggtgacatcagagcatttatccaaacgcttgtttaaatagaaatgcaaaaagaggtgcattgcagtggctgccgtgcagtgtaaatctcacactgggagtgaaatctggggcgctgaggatgtcttgccaacacagcacagagtctgacctactgttagttttttttgctcactgtatgccaccaaatgggaaaactcagagctccaaatgaattacatgctcaccaacatttcacttttcagaattactgctcaagtggtggcaagcagtatgagatttataaacaaacaagccatgccattttttcctatatatatgaaagaatactcctattggtgagaaaattccctttgacagtcttccagcatgtttgtctctatgccaaacagtattgcaaaatattctggctgatagaagagctccaatcccaggttcataggataaacccagctctctgcagctactgtgaacttcaggtatggcttgaattgtgagagtgcattttgccagtgttatatacccactctagggagtgatttcagccactggatgaattaatcttcagaattagttaagtaaacaaatcattacgaaatacattatattatttactaagcagtttatatgtctacagtaatgacaataacacacagaacttacagcagtatgagactgatataaacaacacccctcccttactaaagtattggtgaagccctggcttacttaggtgtgaagcctgttgatgctaatattgaacagtttgatttcctttgtcatttaggtggttaggctgcttctgagccacttctccatttcttgctaattcctattaggctggtcatctccctgtatcagcagatattcagggataaataaaccaaaccttacatctttgtgtttttagacaagaaattttgtaagaaatacaagccacattagccaacgtgttcaggaatctctgctctgccgtgcttctcctttggcctcctgtgattgtgcactgagccagtttgctgttcattagcaccttcaatatgcactgcgcagggctggagagaaaaggttaagatcaaatgagtcaatttggcttcttattagtagctttgacaaaagacttggtggagaaaagtttacaactaatcactaaaatgagaggaaatcaaccgtgctattcctacccctgattcctgagtgagcagaaggttggatgatttttctctttgctaaatggtgtcctgagggtttgaatgcttgtaaaaatgcttgcctttgtattgtttctacagtgggaaactcatcagttgtctgggatcaaatggttttgctaattaatcctttttttaaagcaatttaaaggagcacaaatttattattttatagttctgtaggtcagaagtctgatacaaatctcactgggatgatatcgcagcataggcagggctgggtttatttctggagtatctaggggaaaatctgtttccttgccttttctagtttctagaggctcccagcattccttgctttgtggctccccttcttccatcttcaaagccagcaatatcacatctctctgacccttcttctgtttccacatatgtctgactgcagccaggaaaagttgtcaccttttaaggactcatatgattagactgggatcttaaaaaccaaaatatattttgctaattcacccttccacttaaatgacttttttttgtttctgtttttttgttttgttttgttttgttttgtcttttttacatgaaagaggcatatcttttgggagtaaggtgaagcagaatataaccaagtaaaaaatggagtaaatacagtaattttagatagtggtaagcgctagagagaaaataaggcagggtgaggagtcaaggactgagtgtgatcatgatgttgtttcaggtaaggtggtctgagaaggcctcttggagaggtaacatttgatcagagacctgaatgatgagggtaaaccttgggaagttctggtacaagtgccttccaaacagaggaatggtaaaagctctgaggcaggaaagcattttggctgcataagaagcggcaattaggctggtgaaattgaaacagtgaacaaggtgaaagagtagtaagagaccaaattagaggcacagacaaagatctgataatacagagtcctgaagcttctgctaaggagtttggatttgattttaagtgcagatgggagccattgtctagtgttaagcaggaaactggcgtggcctgatttatggtttaaaaagatcatcccatctgctgtattgggaacagataccagagaaggtaagagttaaaaccaagagttaaaagaggttgttgaaataaacagatgagagataatgtgtgagacttggaataggatgattgtagcagagatgatgacaaatatcaggattttagaacaaattttagggcaggtttgctaatgggttagatttggggagaggacaggattgaggagaaaagagaggtcaagggtataacactttggttaaaggcctgagcgctgtgtggccttggacaagtaacttaatgtctctgaacttgtttattcatctgtaaagtgagaattacaatagctaccttccagagtcattattgcatttatatattcaactaatattaattggcctcttacacgccaaacattttgctgttgctttacattttttttttatcctgagttgattctcacaaggcttctagaaggttattataggacattatttccatcttacatatggaactgatattcggagttgtaaggtttgataacacatggcaagtaaacagcagatgcaagacttaaatccagatctttgcttcaaagcttatgatctatctggctgagtgttactcagatgagtgatgatggacttactcttggagatatcaccctatcttaagaatctgccttattacaactggagactctagtaagaagtaaaactctccaacctttaaagaaagcaacaggatcagagtttctcatctaatttcctgaacttctttaaagagatggaatgggaaaagggcatttagttaaactttgcccagggattcccccaggttgtctttttttttctagtttaattatataccaaatgttactaaacagatggaatcccacaagcagtttagcttgaaaaagcagaatgcctaaaaggagctaacgcaaagaacgatgagggtcactgttgcattgtcaggatagtataaatactgtaaaaagtggtttttaagatagaggaacaacgaacatccccagagtcaaatgatgcttaaaatgaagatgatatcctttttaatacagaggcttctctgtgtgtaaacattgacgtggagtttaaaggaaataagaagtaagaacgtggaaattcccaatcaaccaagttgatctttgtttaatagagaagaaactgagattttagcatttttaagttgcccagcaattcctccaatggaagtcttctggaatcaaagatctcttactcctttaccaaatgtttccagcatctaggagacaaagagaaacactgctcatttctgtcaaaacctggtgctacgtaaccattctgaaagcttttaaatgacctcaagcttctctccatctccagaccagcattcaaaacatcctaggaaaagagtcttttccctttttcccaacatcacccattgttagagatttctctggatattatgaccctttgcctcccatacacattttcacttgcacaaatacctgcaccctgtaatgactttcttctgtgctgtgcactagtgtagtgtaagacatagccaagagcatcccataggttgttaataggcgtatgggtcattggtcctgggtatcagcttcttcttatttttttgttagcaagagactacagattgtctgattcaactgcttgactcagttttagaaaaataaaagacaagaaaactgaatggctgcttttccttagagtagcaacccaagaaccagtgttgaagctgccttcgtggagatattaaatctataacatttgttacaggtagcgatttgtgggttttttttttttttttttttttggtatccttttcgggcaataaacttggcaaaatgaagtcaagtaatcaagtcagggcagaaatatcattatgacagaaggttcaacaagattgtctagttattacattgtttattttcttctaaaaatgtaatactgtagtttaaaagttcacttagctgtaatttggagttgtgttaaagaaacatttcatattcaagttaaatcagtcttgaattttaactaaaagaccacaaaattttgtaaaatacagcatcaaaagtcttggctaatgaaaaaagttaatataaagaaaatttatgaaatagatgggttatgtaacattctacaaagtattaattctgatagttgctgaacataaaatttgcatttcatataaacttataaatgctttctgacatggtagatatatattttatcggaggcagggaaagaggatataccctttgggaaagaactatacaaagatttttatttgactatatagtttgagaatgagtttctgagtaattccaccttttgctcataaagaacctcggcatttgtgttgttgctcaagtttgatgtggcttctccacaggaactttctagatctatgacagtaagagaccagagcagtgagaatatccaggggctttgctgtgccactgacctcactgagtctgttacggaacctgagatctcgtttcagcatccctcaaagtatactggaaaaaactgaggctcagagaaaaataaatccagggcccctttctgtccctaacttcaaccctctatatattgaacaattcagtctttcctggccaggtctagtagacagaaaataattggtcaatggcgtttgcctcgttctaggaagtggaaggagaaataaactagtagtgatgtgagatggcaagagtggagaagagaggtatttttaaaaataagtgggcaaggtagtacataatttgtttcaaaaacatttctgattattatatatacgaagaacaaatgtcttctcaagaaggcagtattgaattgaacaatgagaatacatggacacaggaagggaaacatcacacaccggggcctgttgtggggtcgggggaggggggagggatagcattaggagatatacctaatgttaaatgaccagttaacgggtgcagcacaccaacatggcacatgtatacatatgtaacaaacctgcacgttgtgcacatgtaccctaaaacttagagtataataaaaaaaattgcaactgaataccttacaaggtcaaagaatgactaaacaaacttcagaacctcaaaagagtcttaatcaacaaggatatctatttaaagttgcagaattatcaaccagctaccataatgcacattagatagcaaattttgaaaattcagcccacctttccccaaaatgaagcccattggtgactgagaaatcgtaaaataagatttactagtcatttcagatattgctttatttttcctaaataataccacagtcttgaataaatgcagaccataaactttttttaaaaaattatgaattagccctcacttacaaaagactacctcagttctgtaaagggcctttttgctatattttttcactcttttgttactcccagaaaccctataacatgaagagactgaggaacttaaatgacatttcacaaaataaaaattacaaatggtaaacctacataaacagcattttattcttaagtattcaaggaaagaaaactaaaataaaacataataatagtaaagtaagagtttgcatcagcaaattaacaaaaataaagtgatattaactgagactcctgcagttaatgcagaattgggtcactccgattttactggtggacagggaaagaggatacaccctttgggaaagtaatctgctaatatatcaagaactgtgcaaagatttttatttgacccataaattctgatcctggaaatctgtcacaaagaaataatgccactaaaggaacaaatatattctaaggcaatgatactcaatcaaaggcaactttgaccccaggatatatttggcaatatctggagatgtttttgtttgttacaactgtgagggtgctacgggcatctggtggatagaggccaggaatgttgctacacatcttacacctataggaaacccccccacagaaaataattatcaatagggctgaaactggaaaccctgactctaaagtgctgattgcagaaagtgtgtgtaattagggacacaattagggacacactggaaacaacttagacgtccattaccccaaaaagcagatggatgtttagagaagtcaaattatatctatctatttgatatactattgtgtagacattttaaatgttagagtgctttaaataaaaaatttaaaaaatacaacaaaaagtagaaccaaaaaaaatactagtgccatttggaaggaatatgagtggattggatatggataaatgagtggctatggagtcagtaacacaagtttattgccatattttagatttgttgaaaaagaatcagttcgttcttcaaataatatcatagcgtcagggtcatcttcttccctaactcctctccagctaatatgtctagtttgaaaaaagtactgatcaagtaaaaagacaatgtaccaaattgaggaaaacaccctaagaatttttatggattttgctgacatgaaatttattctcttcagttgcaaactgaaagacactcatctcattcagtctgttcaagaatgaattagcaataacatcctcagcagaatttaggacaatcaacttcttatcatccaagtctgtatttctagatagtactaggtcagaaagaaagacaagaaaagatgtgcaacataatttggagtgacaattgtatagtaaagaaaactaaagatgccaaaaccaaaactacttagaagtgtgtgtgtgtgtgtgtgtgtgtgtgtgtgtgtgtgtgtgtgtgtgtggtgtgtgtgtgtgtttggtgtgcgtgtctgtttggaggaggtgatatcaagtgaaattaggccaatagtctgcttttctatattcttaaatgggggtatggacagtgcaaaaaatgtactgtggtgggcaaaatattttaccaaaagatgtctagctttgtaatttctgaaacctggaatatattgttacatggcaaggaagaattaaagttgtacatagaattgaggctgctaatcagttgattgctaatgtaatcacaagagttttttatatgtgaaaaagggagacaggagagtcagagtctgaggaggagatgtgatgatgaaagtagaggtcagagtggtataatttctggctctgaagatgggaggggactatgagccaaggaatgccggcaacttctaggagctaagaaaggcaagaaaatggatgatctcctagaatctccagaaagaacacactcaaccaatgcctaatattagaagaatgagacctctgttatgcttctgatgcccataactataagataatatatctttcttgttttaaaccactaagattttggtgaattgctatagaagcaacaggaaaccaacacaattacctctttgtaactatgtatgcattatacctgtccatgtatgtgtctgttgggagagcacatgggtgcagttttaccttatttttcttatagtggccttgctctggaaaaatgttactgtttcaagtaatttttttttgtccagtgattgattgtgtgcttgcctggaaataactattcctctggcttctgtcacacgaagaatgcaaggtaaagcaagaaaatgagaaataactttttgaagttcttgttaataaaacaatgacttctctaatagtcaaagtgaaggaaatacgtatgttttgtaataaagaataaaaaaaacagtacagtgtaatgggaaaaaatatagattttgctgtcagacatatttgagttcaaatcctggcatggatattttgagtaaccaagggcaagttacttcacctttctagttcaaaatcacattgtttcttattggaaaaatgacccatcccctgcaaaccttgctgtggtttgaatatgtttaatgtttatattatataaaatggtattcttccaaaaattagaaattaacagtaagataccttgcatgcagtctcgaagagcagtcagagtgatgtttctaaaaatcaaatttggcctctttacgttaaatttgaccccccttacattgaagctttcagtagctttctatcacctacagcagcagttttaaaacgttttggttttatgaccctttttaaatttgttttatgaccctcctaataagtattaaggacaaaaaccatattataaattaaaagaaaagtaacaataataaacccattgacagttaaaataaatactttactaaaaataactatgtttttcaaaacaaaaaatgaagaaaagtgagattgttttatatttttctaactaatttatttaatatctggcttcatagaggaaaactggtttctcatatctaatcctgcattcagtctcttgcaatatatcatttgggttgaattacataaaaaattagcctcccacgtatatgtagttggaaaatagcctcttcatatcattttggttattattcttggatactatggtaaaactacacaagaagtcatttcttaagggctggcaataatgtggtatttgatgtcatattaatgaactttttgtactttgttacattaaagtcccttggcctgtcttatactttgaatggatattacccatgcataatttggtcacaccaaccactggacattttgaaaatattggctcactaagatatatagatctttcaaatgttgacacattccattataaacatcaaacattcacatattttaatatcatcaccaatctcagcagaaaagtatttaagtatgaagaagccgtcaagctcactatagtagatagaagttttccaaaattttaattttcactgaaagcttacattttatcattgacaacaaacactgtcatttgttgtcattgaggtgataggctcacttcatatatttttgagaaaatatctaccaaacgcccagtctgaatagccggtttgcttgtcagtcattctttaaagcaaaaacagtgtttcatgaaaaatgcatctagttcagctcacaattctaaaaatcataccagtgcttttcctagagtcaaccatcatacttcagtctgcagcagaagtgatcagtgcatactttccagttcatcacacagaatgttaaaaacacatgtgctcaaggttgaaatttaataaaatgaatagttttcactgctttattaagagcattcccatgtgaaactttttttttttaactgtgagtatctaacagtgaagaatacaggattactagtatgttctacagtacacatttgcactttggtgctagtgggttttttttgtttgttttggtttttgttgttgttgttgttttgagatggtgtcttgctttgtcgcccaggctagagtgcagtggtgtgatctcggctcactgcaacctcctcctcccaggttcaagcagttctcctgcctcagcctcccaagtagctgggattacaggcacgcgccaccacgccctgctcatttttatatatttagtagagatggggtttcaccatgttgaccaagctggtttcgaactcctggcctcaagggatctgcccgcttcagcctcccaaagtgttgggattacaggcgtgagccaacatgcctggccctggtgctagtcttgatttttgtgaatgtggcaggagtgttacccatcattgctgttgaatcaccagtgaaagtgtcagcagagtgaaaaagtcaaatagtgtatatgtattaattggaaaatagttctgcctttgcagactccctgaaagtgtcatgagtacccataggtgtctgaggaacacactttgagaaataatagcctactagataaattataagttcctaagcaggacatgcacagccttacatatgtggcttctacttttatttccagccttatttctcatcactcattgcctcattgcacttcatggaccaataatcctgaaatgcatctagtccagaatagactatgctcattcatgtgtttctgcattctgatgcttttcagaccatttggtgcacagtaatacataatgccatcccccttgtcttttgtactcctctccccatcctttgagatgtaacccacaagttaatgccttcacagtcttttctaaattctccccacttagagccttccttctctgtgctctttagcactttctgaacacccccatcactcatacttctattaaaatagtcttcttacacttcattctccctctttttatacaaaattatgctcttctttagggtagaaactctgcattatttgcaggcggatagttgtaaccccaattctgttgtctacgtaggtttgcaatacattgctatttgaatgaatacagtaattaatgtaaacctgttcaaacaggtgctggtgaggccgtggccaaacgggaaggcatctacactgttgatgggaatgtaaattagttaagccactgtggaaagcagtgtagagatttctcaaagaacttaaaacagtactacaactcaacccagcaatcccattactggatataaatccaaaagaaaatagatcattctggtaaaaagacacacgcactcatatgctcatcacaacactattcacaatagcaaagatgtggaatcaacctaagtacacatcaacagtggactggataaaaaaaaatgtgatacatatataccatggatactatgcagcaataaacaagaatgagatcacgtcctttgcagggacatggatgcagctggaggccattatcctaagcaaactaatgcagggacagaaaaccaaataccgcatgttctcacttataagtgggagctaaacaatgagaaatcatggacgctaagagggaaaagacagacactgggccctacttaatggtaaagggtgggaggagggagaggatcagaaaaaatacctgtcaagtactgtgcttattacctgggtaataatttctataccagatctccatgacatgcagttcacctatataacaaacctgcacatatacccctgaacctaaaataaaagtttagaaaagcatattccacaagacaagcctggggaaaaatgaacatcccaagaaatcatgtttagtttaaatttcaccaccttcaccacaaacagattttcagtttagtacaatattcaactaaataacaaaatgctagttgctttattcaatatctattcagcaaaattatcaaatgtacacttcttttcctactctatgcctcttgctgaagaagatgagagtcactgattatacaatgataattatgtacttttatgattgaaagcaaaccggatttgaagtcatttttttaaatctgtatgttccatttaataactatgtaaccttgaataaattatttattccccctgagcctcagtttttataggtgtgaaatggagataatagttcttgcttaaaataagttatattaatcacatgagaaaatttaagtaaacacacctattacagtgctcagtacacaataagagtgccataaacatttatttgaacaaagagtacacggtttttatctttgaagttactacaaggtaattttagcatcatacatacgaacaatcctcatttgaggataaaagaattagatgcaaaataaccaagaagtaacacggtttaggagctcaacttaaatatattgtatattgcaaagttgctaatcaaagtttaacattctcaccacccacaaaaatagcaagttggtgaggtgatggatatgttagttaggtttattagatcttttttcaatgtatacatagatcaaaacatcacattgtagctgataaatatacacaatgattatttgtcaataaaaaataattactaaaagtacattgaagaaaaatcggaaaaattaagaagtaggttcattagggcgctatagttccctgctactcaaaatgtggtccacgtgataccagcatttatatcacttaggagcttgtacagaattctgagacccaccctaccccttctgaatcagaatctgcattttaactagatctctaggtcagtcctttgcacattaaaatttaagaagtactttttttagagagacaaatgtcacgtcattaagagttcctacaaaataattaactctggataaatatgtagggccactacttttcttgttccgagggctcacttaaaacgttgacagctttctgagtgctatccttggtgttgatttcaccttacattgaacctaaaaactcaaattatgttacttgctgtctcagtccttttgggcggctatcacagattggtagcctacgaacaacaaaagtctatttctcacagttctggagtctaagttcaagatcaaggcattggcagattctgtatctggtgatggtatattttctgttttactgatggtaccttcttactgggtcctcatatgatagatggaggcaaataagtttcctcagtctcttttaaacggcattaattcaattcatgaaggctctgccctcatgatctaatcactacccaaaggatcttctaaaagtatcacattagggagttaggatttcaacagataaaatgtaggaggacacaaatgttcaggccaccgcacttgcctggatgaagctaacaaccagacaggtctccttgtgaaacaagaaagtgagctttgaagtttgggtgctaaatgaaatacacatgtcatatttcagtctcttgtcaaccttagcagagagatcagtgaaggagaattcttccttgtgctggcataatagacttgaatttcagtgtttgattagggatttcatctgttaaaatattttctgaatatttaattaacacaaatgagtatttaccaagttaagcctagtatatgaatgcccctatataacaggaaagatagacacaggagatgaatttaacaaaagttatttctccgataagttgtaaaaatcagctgtattctttatcattagacggtatggagaatcacagtgattctcaagcattattgtgtatatgaataatttaaaaagcataatgaaatccagagtcttgggcctcaaccctagaagttctgattcagtaggactaaactaagagaatgattagtttatccagttctccagttgatggcctgtaggtcatactttaagaaatgctgaaatctaaccaggtcagaatattgaattggaacagctgggaaatggaagaggtattagcaattatctgaatatttagtatgtactgggtgtattagtaacatgatggcattttactttcccatttttattctgtaagggagctgttatccccattttacagattggaaacaaggtcacatatctgggaatggtggagccaacatatgctcctaagtctctctgactccacaactgatgctcttctcaccatgatacaatgttgacccttaacctatcgtatcctggcttgaatcaatttatttttgtagccatggacaaggtacttcagttttttgagttttagttttctcttctgaaaaatagggacagtaaaagcagctctgtcaatttcataagactgttgtgacaatcacacacaatcatggatgtgaaaatattttgagtttttcaacttttgtttctgcaaaatgcatatcttgatcttggttgttcatccaggggcccaacatagttcaaaatgtaaaataagtgtgaaaatattttatgttgttttgttattgctgcttgcttatttctgacaacaaatcaatgcataatttttgtagaaattttagaaaatatatacaattagaatgaatcaaaatatcattctttcccttcaatcaacacaattttctctccaagttatttttcctctgtgttggcagaaaatcccatcatttatggatccaattcctactcccaggataataccaggatttaaagagctgccaaataaaggtcatggaagattagcttctcacctctcctctgacctattatggtaatagacgttgttctacatgtggggtcttgccaccttcacacaactccttcactaagaggtgttcaggtccctcctaccttgggactcataggtctgtctttccaagactgaagagatctctcccctccctttctcgactttcaaaggcatctttctttcacttttttttatgactccatttacgtaaacctactcatgactcttcagtaggtttaagcttctataaacaataggacatgtctataaatataagctgctttggtactggatcctacaaaaagtgcttgaggcaaggaattacaaaggattgaaccacctgcttgaattgtggggaaaagaaaaaccaacactatgcagccataaaaaaggaagagttcatgtcctttgtagggacatggatgaagctggaaaccatcattctgagcaaactatcacaaggacagaaaaccaaacaccacatgttctcactcatacgtgggaattgaacaatgagaacacttggacacagggtggggaacatcacgcaccggggcctgtcgtggggtcgggggagtggggagggatagcattaggagaaatatctaatgtaaatgaccagttaacgggtgcagcacaccaacatggtacatgtatacatatgtaacaaacctgcacgttgtgcacatgtaccctagaacttaaagtataacaataaaaaaaattgagtattaaaaaataaaactgtttcagcataaggagttatatgggatgatctaaaagtgatctagaaagagggacactaaaggtaattaatgttacaggaaataagtggttgaggacaggatagaaatcagtaggattcattgaaatgggatgtgaaatacagataactggttaaagaaccaaaataaaaaagagtgaggacttctggatgttgaaaaaaaaaaaaagaaaaacaaaataaagagtaatgctcacatacgtatatattttttaaaaatcctaccatatgtaacaacacataaactttctggggaaaaagtacctctaatccgtcattcaggaaaaaacagtgctgtccttttggcacttttttttcctctacattcttgtatttgacttttgtattttagtcttacattgagttttgtatctttgttttcagttaatataatgcagaaattgtttgcccatatcaaaaaactaaagaaatgttaggtcatatcaaaatgtgtacaattataaaagtgttttgataagtaacttcatatgcaatcacttgtatgcattttgacctattttcttaagaagtaaaccttgcagtggaaatataggactgaaaggtacagagatgtaagatatgatgattccattcattcattcaacaaggtcttgagtgtctattacatgccaggcactgcctattattatttattcccaagctagaggagaaatttggctcctttgaatatatctatttggcaaaattaaatgtagcttcagaactcaggtgataaaaatgtcaggaccagctgttcccactgatcatgctcccccttaatgaggagaatgctagggttaaacatttacaatctggattaaatgaattttgatgcccttttggttttgtcaaagtcccagagacaccaaattttaacggttcattagccgagttcaagcatttgcaagatgactgactgtgtaaggagggattgggatcagggcaagctttataagtgtgtgactggtatagctgcacagagtttcgcacttaaaagggctctgcgcttggtttaattctttgctaccaccattttgaaactgataataattttcaaacaaataattttaacatttttattttgcactaggttctgcacagtaaggtgttactgccataaaaatgacacagatgttgggtagactgaacaatcattatgactaattttgatattttagagtactgtctgtttgctatagggcccttcaaatggatcagtccccttggcacaatatccccatcaggaattctgtcaagatgagccataggcagaaataaccttatgtcagtgacattttcccagattatccactctcctgttacgatttactctgctttgcttttccccccttgtctctaatctctgatccctgtcttgtgccagattcccagctgctctccaagtacctgttttcaggctccatttgagcaagctttgggactcagcagcgtttgttacatataatgtgaaagttctttctggacctgattacatgcagttgcaaggaaaaggcattcacatataccccttaccttgaattcggctaaatgcaagagaaagagattagttagttagggggcatggatgcagaaagagttatattgatttagtttggaaatggctgtcttgaagttattctctccgggaaaccttccctaattctccaacaataaattggctgctgcttctatgtggccccatagcactttatactcacccctatgtaacactaaccagattacagggtgagcacatgcttagttaacaatgtctgacattgcaatatacgctacttgggggcaggcaccatgtcttctttgcttatgtaacccccaaatatagctatagtgtctggcacatagtatttactcaaaaaatattcatcaaatgaattaataggtgaataaattaataacataattatttgattttttaattggtaggttttatttttagagcagttttaggtttacagaatgaaccgacccacagtttctcctattattaacatgttgttttggtatgctctatttatcacaattaatgaacaatattgatatattattgttaactaaggtccctggtttacattacgtttcactgtttgtgtggtatatcagtggcttttgacaagtatatagtgacatgaatccacgtctacaatatcatacagaatagtttcactaaaaatccaccgtgttccatctattcatccatacctccctcccctcaatccagtcttagcctgaactcctgacaataaccgatctttctactatctccatagtcttgcctttttcagaatgtcagacagatgcccctcaaattacaatgggcctcatgcagatgagtttctctggatgtaacagcatcataaatcaagaagcatacttaaagcatgttgcttttgcagcatctttttaaaacattgtgtttataattgactcataataattgtacgtttatggtatacactgtgatgtttcaatacatatatacattatataacaattaaatcagagtaaatagctcatccatcgccttaaacagttaccatttctttgtggtgagaacattcaaaagcctctcttttagttgttttgaaatataaaatacaatattgttaactatagtcaccctactgtgcaatagaacaccagaacttacttttcccatctatgattaattttgtaccagctgatacacctcttctcatctcccatcccctcctctctccgacctctagtaaccactatttctctacttcaacttcatcaaattccacatatgaataacatcatgcggtatttgtctttctgtgtctggcttattttacttaacagtttgtcctcctgattcattcatgttgctaaaaatgacaggaattcattctttttagaggataaataatatttcattgtatatgtataaccacatattctttatctatttatccatggatatttaagttgatttcatatcttggctattctcaatagtgcttcaataaaaacgagagtgcagataactcttcaacatattgatttcaattcctttggatatatacccggtagtggaattgctgaatcatccagttgttctatttctaattttttgaggaccctccactctgttttccaaagtcaaaacattgtaagtcgagtcatcataagttggggaccacttgcagttgcaattatatggtatacagccttttgagattgggttatgtcccttagaaatatgctttttgcagttctctatgtttcatcgtgccttcgtagctcatttcttgttatcactgaataatattccattgcatgaatatgccacagtatgtttattcattcaccttttgaaggacaacttcattgcatccaagtacgagcaattatgaatacagatgttataagcattcatgtgcaggcatgtacatgggcataagctttcagctcatttgaataaacacaaagaaatgtgattgctgggaaagaggtacgtggaggagagtgtggaactcatcttgatggcattgctgcacccctgaatccagccatttttgtgtatgcagccagaagcactcctggacatttcagtactatcaagctacgaatccccctttttaacctaggacatttaaagtgagttgtctgccatcttatattgaggagttgtgactaatgcactagtactcctttattgattatcaaatgagctatatttttcctgatgttatatttttatcctatacctgtgtgatcacagagctaaaagcagaactaccatagacccagcaatcccattactgagtatatacccagaggactataaatcattctaccataaagacacatgaatataaatgttcattgcagtagtattcacaatagcaaagacatgaaatcaacctaaatgtcctttaataatagattggataaagaaaatgtggtacacgtgtaccgtggaatatgatatatccataaagaagaatgagatcatgtatttagcaggaactaggatgaagctggaggctattactagcaaacttacgcagggacagaaaaccaaatatctcatgttctcagttataagtgggatctaaatgataagaacttatgaacacaaggaaggaaacaacagacactgggttctacttgaggagggatggtgggaggagagggaaaagtagaaagcataactattgggtactgagcataatacctgggtgatgaaataatatgtacaacaaccccccttgacacctgtttacctgcataacaaaccttcacatgtacgccgaaacctaaaataaaagttttttttttaaaaattccaaatgttggataaagttttctcaagaagcataagtgacttttcacctttttttccctctaaatacctatgtaggaaagctacataatttacctgagtgtcagtttcttagtatttatcctacaaaattattgcatcagataatctataatagttgtgtattcttcctctcatacacacacatccagttttctgaaaatccccttttcaatgataaaaactttaattccatttcagacagaatctacttgatctcttgagcttactgtttaccttcttctcaaattacactcttcccttggcatctgtaacttattctcagactttcttcttatttttctggtgctctttttaaatgtcatgtgaaggctccttctgaagatgatgaggttacatcttagacttggcttattttcagatttctgaattgaggaataacagttctaacagtaaacactcagctgtgtgctactgtgttcgatacacaatagccactggggtacacacttatagcccttggctgtgattatgtttttcttcagcttctttgttgagagtagggtggtgaggaggcaggcaagatggtgtgttctgttaggtttctttacatgctttagctccagcatttatggcaccccttgcttgtgatccgtctaaataaagattgcccatcaggcttttgtgtatatgagctctcatgaaaataatctaggctttgtttatagattaacaacacaacataggagtggtgattacagccagcagaagagataagatcagctagagattgtgtaaagggaattgagcatcatattgaggccaagactatagtaaatactgtgtgtgcagcaaaggacccctcagaagagtacttctttcccctgaattgcaaaacaatttgccaaaaagaagataattgaaagagaatatcaccactgatagagttgaaagaattatagcagtgggaaccattgcccagggtgcaggcaatatgggatatattgtttgtagacaatttgaaaccagtaaagttgactgagaattggtctgtttttttactgtcactatccactggcaattctaaacaaagtcagtgataaaatattctcctggaaaaatgttttggtcttagttctaaacagttgctgcagaatgtagttatgtttaatattgtatatgtaaacttcatgtttattacctattctttaatcaacattgtgttctatgggaacattattttaaagtactcttagtcatacagttgtcctctgatatagctatatgcattcatttcatgaataagtaacaatttgatggttcaaggcctttcagatcattcctgcatccaacacttgtggaactacatatatgtaggcgtgaacagtagattggaaacaatgatgacctagcaattgtggagacaggattgagttcatttttattttagcacaaaaatgagctattactatattttatagtcagtaataattgttatctacatatttaaccatttgatttgtatattgtttctcacatcctgctcttttctctggttaaaatacatcctttcttctgctctttggtagttttgtggttgcctccacacagtctcctgggaaccacatgtccagaaatgggcctgataatggtaacgcaatggtccttccctgcagcaatattgaagatgacacaaattcattccctcagcctgtggcttgccctagttcctggtagtgcagctgcttgcatcctttagccattgagatacacactcacagcccttggctgtgatcatgctttcattcagcttctttgttgaaggtagggtggtgaggaggcaggcaagatggtgcttttgcatatttcttttccaggagcctaacaggctgcatgttatgttccatttctggtttatggagatgtgtatcttggttttcaagagtgattgctttaaaaaaaatccatcattgttatgttgggagccaagtggggattttactgaatgtaccatacagaaccatcttggccggaagctatagttaggaccttgaggctctttcaaacagaccgatgcaatcagaaaatctgttaccaagcaatatattcacttataacaagaacctttataatatcagaaatgctttcaggagttgaaaaatatcttattgaaacttgtttttcataaaactaaagtactagtacttgatacatcattactgggaatgctgtgaaatacgatttccttcaaaatttcccaaatacattactttattaaaaccacttattttttaaactacaactctaactcctaaggattcacagatattgtgttcaccatactcaacatgtagctgaaaacaacataattggggaaatatacacagtccttgacaaatcataatttgagagtttgtttgcttccagttgccagagtactgtggaatcctgtggtggatttaagttttataagtttgttttcttttgttcttgaatttttaataagatgtaacacttgagtatgtacagcccttgccatttgaacaccatgtactcctagagactctaggagagtgaaatgccccactatggactctgaataacataagtcatgatagtaaagctataacattacatacaagcaaagccatggtaagccttcataacttttgagatagaaaagcttgcccaggtcagagatgcataacaatataactgcagtttcagccttgctttgaattctgactgctatcttgggaaagtcaacccctttgacccacatggtaaaaggaggacagtgacagtcacttcacaggtttaggatgagaattgcaggatatgagtgatgctccatgcaacaatggacaattacactgagagcaacatgggtgccaagagagattttggtgatcagcacttacctcccataagcaggagagcatcaaaaaatagttaggaaacaaatggaactagccaaactcattatttcattaatgagtaaagtatgcctcaaaggcttcacaatgctagttcttgccagacccagaactcatttctaggtttcttttcttttttttaaagatggggtctgggcttggcgcagtggctcatgcctgtaatcccaacaccttgggaggctgaggcgggtggatcagttgaggtcaagagctcgattccagcctgggcaatatggagaaaccccatctctaccaaaaatacaaaaaaaaaaaaaaaaaaatagccagtcatggtagcgcatacctgcagtcccagctactaggaaggctgagtcaagaggctctcttgcacccgggagacggaggttgcagtgagccgagatcacactactgcattccagcctgggcaacagagcgagactccaactgaaaaaaaaaaaaaaagaaaaaaagatggggtctggctctgtcattcaggcaggagtgcagtggcgtgatcacagcacaggctcgaactcctggactcaattgatcctctcacctctgcctcccaagtagaagtagctgggactatagacaccatgcatggctttttgttttttaaagccagtgagttagatacacaacaagtgagcatgtttgtggttcatgctttaggcagctaatgactatgagattctgagctttgtatcatatatatatatatatatttgataactatatatatttgataactatatatatttgataactatatatatttgataactatatatatttgataaatatatttgataaatatatatttgataaatatatatatttgataaatatatatttgatatatttgataaatacatttatttgataaatgtatatatttgataaatatgtatatatgagataaatatatatatttgataaatatatatataaaacaattatatttctcatttgttcaatgctgactgttagaaaatctattttgttttcctaaaagtaaagacagagggttggggatgaagtacctttattagtaagtatcatgaacataatctcataatgactacttactaatttacagtataaatagaatagcgctatccttgaattgtagcttctgatgtgtgttaggtaacttcatgacatttgtatagttaaatgagcataatattgaaacaaataacagatcagcttagtgcagctgtcctgcaggtgagcctgtgccatgggataccacttctctttccatggtttatagatcatgtctctagtcagcctgcatgcacagagtggactcagtgaaagaaatgcagcaaagaagcctaatgggctactcctggtcccagtctcaactactgttcctcatagagttttcatagtctccatcaacttttgtggctctccaaattcaggtaattagtgggatgtaattttccttttggtaactgggatataatctacctatgcttgagattatatccttatcttttcccctcttgggccttatttcatcaactatcaaaaacatcttcattctttctttctccactggatcttaactcgcagtctaaaaatttcttaagtctagtttctgaaaatcagactctaaactagggaatgttggaacagtgacttattaaaggatattctttagtaaacacctgtaagtgaggaaatgaagcaagataaaaagtagtggaactcagcaaatacgtagacttggcaaaaatctagtccaggaagccccatactattttccatagctactgcaccatttcacattcccaccaaaagggtacaagggtttcacttcctccatattttgcctaacactagtttgagatatatatatatatatatatataaaatacacacatatataatatatatacatattttatatgtagataggtagatagatagctatcctaaaaagtatgaagtgatatctcactatagtgttgatttgcacttctctgataattaatcatgttgagcatatttttatatatttgttggacatttgtatgtcttctttggagaaatacctgttcaggtcctttgcccattgtttaattggattatttggtttttggctattgaattgtaggagttccttatcttttttgaaagttagcctaggttgggaaaaattctcaaaccatgatttcctctgctctgacaccacagccatcattaacacagaagaattctgtgaccaaatgttggggagagttaagttttacctaccaccaagtgagcaattaattttgtaaacaacaccaactgggtgtcctccaagtcaattctgatgctatctacctggaaatagtttcccatcccacaagttgagggctcagttcccaagactgccctttctaggacactagtcacatgtgcaggtctccagaactgacccacaggcttcaagttgggtttcccatgatccctactttgggttcaattaatttgatggagcaggtcacagaactcaggaaaatacttacttacatttactggcttaatataaaggatattaacaaaggatagagatgaaaagatgagtagggtgagatgtgagggaaggggcatgtagcttctatgccctccttgagtgtaccacactccaggcacctctgcctgcgcagctatctagaagctcctgaacctgttcgttttgatttttatagaggtgtcattacgtgagcatgattaaaaactgtgtagaaatatgactggacaaaagggcattatgctaagactgatttgggaaacaaagcaaggcatgtcttttaagagtcttcttggtttgtctgtacagcattcctgcctccaaagtatgggcagaaccctctctgaaatgagggttttttgactcatgatcacattagagtcctgcttttcgaaaggtaaaaggacaggagagggtcagaaagacatattctatttcctgatgtctgcttctagtgcttaaagtgccccaacattatgacaaaatactgtaataaggtctgtggcagttacaaggcaggaaccatggataaaaaccaatctgtatttggttctgtttacatgctggataacgtttattgatttgcatatgttgaagcagccttgcatcccagggatgaagcccacttggtcacggtggataagctttttgatgtgctgctggattcggtttgccagtattttactgaggatttttgcattgatgttcatcagggatattggtctaaaattctctttttcttgtgtctctgccaggctttggtgtcaggataatgctggcctcataaaatgagttagggaggattccctctttttctattgattggaatagtttcagaaggaatgttaccagctcctccttgtacctctggtagaatttggctgtgaattcatctggtcctggaccttttttggttggtaagctattaattattgcctcaatttcagagcctgttattggtctattcagagattcagcttcttcctggtttagtcttgggagggtgtatgtatcgaggaatttatccatttcttctggattttctagtttatttgtgtagaggtgtttgtagtattctctcatggtagtttgtatttctgtgggatcggtggtgatatcccctttatcattttttattgtgtctatttgattcttctctcttttcttctttattagtcttgctagcagtctatcaattttgttgatcttttcagaaaaccagctcctagattcattgattttttgaaggtttttttgtgtctctatctccttcagttctgctctgatcttagttatttcttgccttctgcgagcttttgaatgtgtttgctcttgcttctctagttcttttaattgtgatgttagggtgtccattttagatctttcctgctttgtcttgtgggcatttagtgctataaatttccctccacacactgctttaaatgtgtcccagagattctggtatgttgtgtctttgttctcgttggtttcaaagaacatctttatttctgccttcatttcgttatttacccagtagtcattcaggagcaggttgttcagtttccatgtagttgagcggttttgagtgagtttcttaatcctgagttcttgtttgattgcactgtggtctgagagatagtttgttgtaatttctgttcttttacatttgctgaggagtgttgtacttccaactatgtggtcaattttggaataggtgcggtgtggtgctgaggagaatgtatattctgttgatttggggtggagagttctgtagatgtctattaggtccgcttggtgcagagctgagttcaagtcctggatattcttgttaactttctgtctcgttgatctgtctaatgttgacagtggggtgttaaagtctcccattattattgtgttggagtctaagtctctttgtagttctctaaggacttgctttatgaatctgggtgctcctgtactgggtgcatatctatttaggatagttagctcttcttgttgaattgatcctttaccattatgtaatggccttccttgtctcttttgatctttgttgatttaaagtctgttttatcagagactaggattgcaacccctgcctttttttgttttccatttgcttggtagatcttcctccatccctttattttgaacctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgtcagctggttattttgcttgttagttgatgcagtttcttcctagccttgatggtctttacaatttggcatgtttttgcagtggctggtaccggcttttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgctgaatattggcccccactctcttctgacttgtagagtttctgccgagagatcagctgttagtctgatgggcttccctttgtgggtaacccgacctttctctctggctgcccttaacattttttccttcatttcaactttggtgaatctgaaaccacatgattatctcaaaagatgcagaaaggccttcaataaaattcaatagcccttcatgctaaaaactctcaataaattagatattgatgggatgtatctcaaaataataagagctatttatgccaaacccacagccaatatcatactgaatgggcaaaaactggaagcattctctttgaaaactggcacaagacagagatgcccactttcaccactcctattcaacatagtgttggaagttcaggccagggcaatcaggcaggaaaaagaaataaagggtattcaattaggaaaagaggaagtcaaattgtccctgtttgcagatgatatgattgtatatctagaaaaccccatcgtctcagcctaaaatctccttaagctgataagcaacttcagcaaagtcacagggtacaaaatcaatgtgcaaaaatcacaagcattcttatacaccaataacaggcaaacagagagccaaaccatgagtgaactcccattcacaattgcttcaaagaaaataaaatacctaggaatccaacttacaagggatgtgaaggacctcttcaaggagaactacaaaccactgctcaacgaattaaaagaggacacaaacaaatggaagaacattccatgctcgtggataggaagaatcaatatcgtgaaaatggccatactgcccaaggtaatttatacattcaatgccatctccatcaagctacctatgactttcttcacagaattggaaaacactactttaaaattcatatggaaccaaaaaagagcccgaattgccaagtcaatcctaaaccaagagaacaaagctggaggcatcatgctacctgacttcaaactgtgctacaaggctacaaaaaccaaaacagcatgatactggtaccaaaacagagatatagaccaatggaacagaacggagccctcagaaataataccacacatctacaactatctgatctttgacaaacctgacaaaaacaagaaatgggaaaaggattccctgtttaacaaatggtgctgggaaaactggctagccatatgtagaaagctgaaactggatcccttccttacaccttatacaaaaattaattcaagatggattagagacttaaatgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgccatctactcatttgacaaagggctaatatccagaatctacaaagaactcaaacaaatttacaagaaaaaatccccatcaaaaagtgggtgaaggatatgaacagacacttctcaaaagaagacatttatgcagccaacagacacatgaaaaaatactcatcatcactggccatcaaataaatgcaaatcaaatccacaatgagatataatctcacaccagttagaatggtgatcattaaaaagtcaggaaaccacaggtgctggagaggatgtggagaaataggaacacttttacactgttggtggaactgtaaactagttcaaccattgtggaagatagtgtggcgattcctcagggatctagaactagaaatgccatttgacccagccatcccattactgggtatatacccaaaggaatataaatcatgctgctataaagacacatgcacacgtatgtttattgcggcagtattcacaatagcaaagacttggaaccaacccaaatgtccatcaatgatagactggattaagaaaatgtggcacatatacaccatggaatactatgcagccataaaaaaggatgagttcacgtcctttgtagggacatggatgaagctggaaaccatcattctcagcaaactattgcagggacaaaaaaaccaaataccgcatgttctcactcataggtgggaattgaacaatgagaacacatggacacaggaaggggaacatcacacaccagggcctgttgtggggtggggggacgggggagggatagcattaggagatatacctaatgtaaatgacgagttaatgggtgcagcacaccaacctggcgcatgtatacatatgtaacaaacctgcacattgtgcacatgtaccctagaacttacagtataatatatatatattatacatacatatatatataatatatatatattatacatacatatatatataatatatatattatacatacatatataatatataatatatatcatatatattatatataatatatatattatatatattatatatattattatatattatatatataatatatattattatatatattatatatattatatatatattatatatattatatgtattatatatgtaaaaagatagttatatccaaaggacttaggcagattgacaccttgaattatcagttaactttgtatttgagatctagcagtgttctcacaaggcatggtatggtggcttggggctaagacttggattgaaagggaggttaattgtgttgagctggattactttgctacattccatgcagcagtgctgtaggaagggctggctgatgggcaatacctgacagtgccttctgaagctctcagaaggaaaatagttattaaaagtctgtggcctttattaccttgggacttgatccttcatctgtccaagccaagtccccttcttgctgagaacaaagtgaggagagagggattcgctcagttgcactgagtgtgtgatttcttggcctgttcttagcagggataaaactgccctggtagccccccatcatgaaaaggagtcagacaaaaagtgtcctgtgttctggctgctacaggagcagggctgtgatctgcttagaagaaattatcctgcatccctggtactctgagaaataaattcttggtgcttctgcataacaggaaaaaaaaaacaatctgtatatataagcataatacaacaaactccttatctcatatatgatttaaaaatattttcttccattctttaggttgccttttttgttgttcattgtttcttttgctgtgtggaatgcttttgttttatgtagtcccacttatctatttttgcgtttgttgcctttgcttttggggtcataccaaagaaattattgccagccaatgacaggaagcttttttccctatcttttcttctaggagtttcacattttcaggttatacatttaagtctttaatctatttttagtttacttttttattgttttagataaaggtttggttttattatttcgcatgtgtatgtctagttttcaaaaccgtttgttttaaaaacaatcttttctccactgcatgttcttgacactcttgtataagatcagttgactgtatctgtgtggatttacttctgagctctctattcttttccgtcagatttatgtttttcttatgccagtaccatactattttaattactgcagctttgtaggatagtttgaagtcagaaaatgtgatgttttcagctttattcttttttcttaagattcctttggctactctgggtcttttgtgatcctatgtgaattttaggattatgggtttttttttttttctctaaataatgtcagtggaattttgatgggagtagcattgaatctgtaggttgcatttggtaatatggacctttttaacattattaagtatttaaatccatgaacagaaaatacctttccatttattcgtctcattcaatttcttttatcaatgttttgcagttttcagtgtacaagtctttcacttcttcagtaacttcatttctaaatattgtttctatgctattataagtgaaattgttttttagtgttctttttgatggttatttgtgtatagaaatgtaattgattttgtatgttgattttgtattttgccactttgctgtattagtttattagtttaacagattttttgtggggtctttaaggttttctacatgtgagatcatgtcatctgcaaacacagattattttacttcttttcattttctaatttgtattccttttatctattctcacctaattgctctggctaagattaatagactatattgcatagaagcggtaatagtagacatcctcatctaatttctcaaaaaattaaaatagaactaccatgtgttccagcagttcaacttatggctatatttccaaaagagttgaaatcaagatcttgaagagatatctgtgctttcatattcattaaagcattattcataatagccaagaagtggaagtatcccaaatgtccatcaatagaaaaatacatttttaaatgtggaatatacatatgatggaattcagcctttaaaaagaaggaaactttgccatttgtagctatttagatgaacctgcaaaatattattctaagtaaaataagctagtcatagaaagatattgcatgattcctcttatataattatctataatagtcaaatccatatacagaacatatacagtgtggttgccaggggatagagggagaattgggaaaatgaggaggttttgttcaatgggcataatgctttagttttgttaaataagttctagtgatctactatatgacaaagtgcctgcagttaccagtataatattgtacacttcaaaatttgtcaagagcgttgagctcatgttaactactgttcttactaccaaacacacacacacacacacacacacacacacacacacaaaaaaaaaaaaaaaaaaaaaaaaaccaaaggaatacaaagaaactttgggaggtttgcatatgtctattacattgatcatgatgatggtaccattgatgtttgaccatatccaaacttatcagattatacacgttaaatatgtgtagttttttgtatgtcaattatacttcaataaacctgttttacaaaaagtctagtctagatgcctcatgagcaaaatatctggagcataaacattacctttgtgttatcctcacttgaagtaagtgagccagccttttacatccttctatcattcagccattagttatggaccaccacactaggtgatgtacatttccaggcaaggtggctctgatcattttcagcagctagaagaatgaatccactcactgaataaatgggttttgggaagcatgacatcacaatgtctactaccgtccatcccttctgccattcaggcctttttgcttcttaatattaagttcagcacatttgagcatacattctctagcacaattcctggtatttatgtatttatttaataaatttaaggtacatatttaatatgtatctcctttcccaccactgattccagattttccttaacttcaactatcacttctgctggtctaggtggctttcctcgtgggatgactttgaccctaatctctgagaggtctgaagcccagtgtccattcccttattagatctgtggttactgcactttcccattcatagttaagacagagcatggaagtaccaagagatgccacaatagatcacctgaatgccaaacgtactctttgctgcccacattatatagcaacgctcttacctcctcatgatgatcaggattaattactactgccaatataataactattttcgatatctgttggtatacttgcagaagaagcccaaagtaaccaggcagtggctgtaagctttatatgcagcaggaatcttactgtttctactgtggaagtgatcccactgtgagaaccagaatctctacactcacagagcctaaaatcgaggagactggcaaaacacatcccccaagttcataattgggagtaatggtgaagacagctagtcttaattccacccctttcttcctgcacctatgtatactatctagtgaagacacagaaccgcatcttgtccgtagatttaaagaataaaacgtatcctgcagaataacgcccatgaataaggggtctcattcccacagtgatgcctcagcaacatctttagaaggtcatttgccactgtattagtctgtcagttcctgaggagtgcattatattataaaactagtggatctcatgatcatgtgcctactgccacacctcctttgccgtaaaatgggccccttcatccaaggcaatgttatgcaggttctcacagtgagaaatcagacccactgcgaggcttcagataacagtttgggtcaagggcctgtggtcagaaaatgtaaacccatacccagaaaattatatatatatatatatatatatatatataattataataataattacatatatgtgtgtacatatatgtatatgtgtgtatatatgtatatatacgtgtatgtgtgtgtgtgtgtgtatacatatatgtgagagaatatattgcttcacttttcaagtagaaagttcttcaatgtgattcaacttgccacagactagttgttcatatcctcaaaagttagtgccatattagggcattgacatctgtctttgttgtcagcattttagtggtagctgaggaaaaagcttgactatcagtaatttgctaggttatctgtccagtggatatttagttcttctaatggaacagatgctgtttaggtgaactaatgttaaaaaaaaaaaaagacctttacactttgtattcactcacgtaagtccatcacgtattcagtcttgcaccttgctccgtctgggctactgacgaaccaactaagccacttagtggggctcatatatttattgaaacctacccctatatcatgccacatctctctccaaataaagtgagttaccagatgcactgacaaaaacttttctaattgggaggatttcccattaccactttatttcaaggtaagcctgagaaagaatgcaaatagcagcagcccattttcagtttgcaccaatgtcccatatctgacatctttttttttttccacctggacacaaggacactccaaaaagacaataggtgtagtctgaatgagaggcatcaatctctgagcatgatctgagtgagaccctactatggttgggtattagatatctgtttgctcagcttatttgtatcctttgctgtgcaccatcccatttcttcttattagagattgtgactggacctggtagactttatgaaatccaggaatggaattttctagtttatgattggtagttgtggccacagggtcacttgacttcccttgctcaagtgcttcaatatagtaaagcgacgtgatgttctgtggaatagccagatgtgtccagatatttttggactctattatattgcaaagagccagagagctaacgtatctctggaatgcttcatattttacttcgtgatgaatatgaaacataatatatttgccacaccaatacctatgttcacaaacctaagactgttaataggctttagtgaagataccacagatggcacaatcgttgtaattagggctgctacttgattaagtttgcattagtccactgtcataagtcattatctggattttttcaggaaccagaaaggagataaattatgatcaagataaacacctctgctccctccacatctctgaacatggtactaatctgttattttgctcaggatgcaacgtgtgtgtgtgtgtgtgtgtgtgtgtgtgtgtgtgtgtgtgtgtgtgtaaagctgatatacatagaaatttacttttttggacagttctatgaattttaacacatgtacagatctgtgtaaccatgaccacaatccatatatagaacactcacaccaccccccaaaatccttcgtgtgtgttttttttttttttttttttttttttaaggcaaagttttactctgctgcccaggctggagtgcagtggtgtgatctcagcttattgcaacctctgcttcctgggttcaagagattctcccacctcagcctcctgagtagctgggattacaggcatgtgccaccatgcccagctactttttgtatttttagtaaagatggggtttcttcatgttggccaggttggtctcaaactcctgacctcaggtgatccacccacctcggtctcccaaagtgcttggattacaggcgtgagctactgcgcctggccttgtgttgtcttttaatcatcactccccacccataaccacaatccacaatcattgatctgttttctgtcacaatagtttatcttttagagaatgttatataaatgtaatcatataccacataatattttgaaagctagtttctttcactccatcatgtctttgagatttatccaagttgcatgtatcaattattcactcatttttattgctaacaagtactctatggtatacattaccatagtttgtttatccatgaacttattgaaatatatctgggttgtctttagttttggtaattatgaatgcaattgctataaacagtttgtgtacagtttttttttgtgtgtacatatacattttagttttccaggataaatttccaggaatggaatcgttggctcatattataagtgtgtgtttaccattataagaaactgccagatgttttccagattagctgtaccatagcattaccaccagtatgagggttctggttgatttgcattattgccaatacttaacattattagtatatgtagatatgtacatatgtgtgtatatgtatatatcaccttatatagccatatatatatatatatatatatgtatgtatgtatataaccattctaataagtgtgtaaaagtattttcaccatggttgtaatttttattttcctaataggtaattatgttgaacatcatttcatgtacttatttattactcatatatcttctctgaactgtctgttaaatattgtgatcgtttttaagtcaggttggttgttttcttactattgaattttgaaagttcttcatatgttctagacacaagttctttgttgaatatgtaatttgcaaatattttctcacagtctataccttgtattttccttctcttagctgtgttttcatataacaaattttaaaatttagattaaatcttttaaatcatatttttattctatgaattatgattttggtgtctatctattttcctaaacccagatcatgaaacctgtttttctctacaagttaaatacttttatattttacttttaaatttatcatccactttgaattaacttgtacataaactatcatgatgtttaaatggagttttttgtttttatttaccctaaatatgtccaattgttccaacactatattgaaaagactatttctactaagttacctacacatcattgttaaaatcaattgttcacctttgaatggacctatttctgaactctattctgttatattgatctctgtgatgaccatcaactccataatgcagtgattactggggctttacagtaacttttataatgaagtagttaacttctccaacttattcttctctttaaaagttactttggtagtttatttgtattttcacataaaatttagataaagcttgtccatagatgcaaaacattgggctaggattttgattggaattataagtctgttcatcaatttgtgcggaattgatttttttttaactatcttgagtgtccaatccattaccacggtatgtctctccatttatttgtcttccttaacttctcaccacagttttttggagttttttcccttgatatcatgttttattatctttatacttaagtatttcattattttaaagctgttatgaatggcattgctttttaaaaatatcagtttccaattgttcatcactactatttaatttaagattgactatgttgtgttgaccttacatctcatggcattaataaactcacttattaatccaaagagattttctgtagattccttggaacttttatgtaagtaaatatgttatctacaaatctagaacaattttatttatcttttcttcaatatgcttcctttttatttatttgtcattatattgcactaggtaggatttccagtacgatgttgaataggagttgtaagagtggatagccctgccagttttcaatccaagggggaaaatattcagtttttatgtttcctgtaggaattttgtacattttaaaaatattttgaaacagttttcttctattcctagtttgttgaaagttttttttgtcattaatgaaagttgagttttgtcaaatacattttatataaagttttatgatgatgtattttccttttataaactgtaattaatgtggattgcactgattgattttcaaatgtatgccagacttgcattgctgtattaaactttcttgtcctagtgttttattctttacatatactgaagtatggttttgctgacttgtttttaaggattttgcatctgtgttcaaaagccatactacactgtaggtttttttgtattacatttgtctggttttgttatcagagtaatgctggactcatataacttggaagatgctcccttttctgttttatgtttttctctgtaatttatatagcagaattgatgttatttgttttttgaatgttttgtggaattcctcagggtgactattaaagctgtatgatttgttttttgagaggttttgagctatcgctttgagcaaaatgctaatagtgatacagacaatgaaatccaggctgaggtggtcttagatggagttgaggaacttcttgggaaatggagcaaagaccacttccttagagatctgtggaactttgaacttgagagagatgatctgaaattggaaattacatttaaaacggaagcagagcaaaaggtttggaaaatgtgcagcctgaccatatggtagaagagaaaaacccattttctggagaggaattcaagctggctgcagaaatttgcataagtaacaaggagccaaatgtaaatttccaatacgattggaaaaatctctccagggcatgtcagagaccttcatggaagccagtcccattacagacctggaggcctaggaggaaaaaatggtttcttgagtcaggcccagggccctgctgttgctcagtgcagcattgggacttggtgttctttatcccagccatggctaaaagaagccaaggtactgctctggccattgtttcagagggtgcaaggcccaaaccttggtggcttccacgtggaagcatttgatgttttcaatgttttgggttttagctactcaaatagatatgtaatggtacctcaatgttgtcttaatttttaattccctaatgacatatgatgtttatcattttacaagtctgtgccaaagataaagactgcaagaaaatatttacaaatcaaatatacaacaaaggacctgtatgcagaatacatgaaggattttttttaaattcaaaaatcagaaaacaacagctcaatttttaaaataggcaaaatacatcaacacacaactcactaaagttgacatatggatgttatataaacatggtaatttttcttctatatcatcagccattagagaaatgcaaattaaatgcatgattcaaacaggaaaaaatgatacattgaagttactcaatataaataaatcattgtctccccagggcttatagaagaaacaggctgaatattatgtggttccctgtgtactacagtgagatgtaccctcaagtgtcttaaatgtattcgtatttactccagccaagatgtacatcccctcccttctactgacctgaggatggcacccttgggctaaggccaccatctccctgacacttcagaaaaggaagccagaaggaaggagagggttgtgctgcttgacattcattcactggggcctctcagggcagacaataaggccacatttctgtgaggttttgcatgtctgttatgagaggcccttctgcatttcttctgggtcctcactgaaagaagcactggaaaagggtagaaaagacaatcttgaattccctatgctatgccgccctcatgccctaacattagctgcttggtgaagagaaagtctgtgtccttaacagagggagagcacagggattatgagatgttgaattgaactcagtgctgctgtgtcagagaacaaaggaaatttggttcaaattcagccagtgccctcccatggagggagcattcaaaccagctctagccagaggaaaatcactcatcctagtggtcattaacgtgagttctgtcaagcgtcgccaccacaaaccaaagtgctctggggctctaaatgaacttgaaaggcagtctaggccagaaggactacaatttccaggtgagtctgagtaatcaactagactcagtgccagtggacatggaaagcatttgacccactgagacacgagctggagcatctaaaggagtgcttgtaccacccctcccccaaactcaggctgcatagctcacagagccaaaagataccccttccttcctcctgaggagaggagagggaagaataaagaggacgatgtcttgtatcatggatactagctaagtcacagtaaggtagggcattattcagaatcacgaggttcctttttcaggccctagctcccagaagacacttctagacacactgtggggcagaagtgaacccattgccttgaatagaaggactctttcctagcaagacccattacctgctgactaaggagcacttgggccctgaataaccagcagcaatttctgggtaatgtgccatgggccctgggtgagactttgagacttgctagcttcatgtgagactcaacacattcctagatgtgatgggtacagggagagacactttctgcttgagactttgtcctgtatcttaggtaccagctcagctacaggagagtacagcaccaagcaggctcttgaggtcaccaattccaggctttggctgttgaacagaatttctggacctgccgtcagccgtaggggagcccaatgccctgaaggatgagtcttaggccatgtagcattcaacacaatctgactgtagagtccttgggccttaagggaactttggcagtagcctggcagtactcctagcgggccagtggtggtcgtggccatgcactgaggcttctcagcctgtgaaaatgggagaaaagagtgggaaagattgcctcttgtggtttgagtgccagtccagcctctgtacaatagaacaccaggtagaattctaaagtttttgattccattccctgactccggaaagcacttttggatctgcctgtggctggggaacttgctgccctgaaaaaaaggacataagcctggctggctttggcacctgctgattgtagagacttagagctttaagcaaacataggcagtggccaggtagtggttactgtgggtgttgtgtaagacccatgctgtgcaggtttcaagtctgatcaagtaccattccagtagtggtggccacaggggtgtttgtgccacctttccctcagttccaggaggctcagaatagagacagaaagatactttggttgtttaggatattgtaaggaagaaaaacaagagtctgtgcctagtaatccagagaattattccagatcttcttcaaggcaatacttctatgagtcttcaagaaccacagagttgctgggcttggggtgtcccctaatgcagatatggcctagatcataatactcaagtccttttgaatacctgaaatctttaacaagaaggatgagtacaaagaagcccagactacaaagactacaataaatatctaactattcaatgtccagacactgacaaacatccacaagaatcaagaccacataggaaaacatgacctcaccaaataaactacatgaggcaccagggacaaatcctgagatatatgacctctttgacaagacaattcaaaatagctgttctaaggaaacaaaataaatcaagataacatagagaaggaattcagaatcctatcagataaataaatttaacaaagagactgaattaaaaagaataaagtagaaatatgggagctgaaaaatgcaattgacatactgaagaatgtatctgagtcttttaatagcagaattaagcagaagaattagtgagcttgaagacacactatgtaaaaatacatagtcagaggagacaaaagtaaaaatatttttaaaagtgaagcacacatacaatatgtacaaaataaccacaaaagggaaaatctaagagttattggccttaaggcaggggtggggggcggtggggggtgggctataacgtttattcaaagagaacataacagagaactttccaaactcagagaaacatatcaatatccaagtacaagaagcatttagaacaacaagcagatttaatccaaagaagactaccttaaggagtttaataatcaaactaccaaaggccaaggacaaagaacgaattctaaaagcagcaagagaaaagaggcaaataacatacaattgcacttcaacatgactggcagccgacttttcagtagaaaccttgcaggccaggagagagcggcatgacatatttaaagggccaaagaaaagaacttttaccctagagtagtatattcaggatcaaaaaattcatcaaacatgaaggacaaataaagactgtcccagacaaatattaatgtaacctgagggatttgatcaacacaagacctgtcctataagaaatgctaaagggaacagtacctcaaatcagaataaaaatgatgttaatgagcaataaaacatcattaggaggtacaaaactcacaagcagtagtaagtacacagaaaaacacagaatactataacactgtaactgtgtacactaatttgatcttaagtagaaagattgaacaataaaccaatcataaataataactacaataagttttcaagatagagagtaaaacatgatataagcacagatattaaaaagtttaaaaagcagggggataaagttatagtgtagagttttattagctttctatttgctttttagatttttaatgtaaactgtgttgttatcagtttcaagtaatggattctaatatggtattcacaagcctcacagtaaccttgaatctgaaaacatacaacagctacacaaaaaatgaaaagcaataaattaaatcatatcaccagagataattatcttcacagaaacaaaaacaggatggaaaaaagaaggaagtgaaggctacacaaaaactcagaaaacttacagcaaaatgacagaaatttgttcttactgatcaataataacattgaatgtaagtggactaaactctccaattagaagatatagagtgactgaatggattaaaaaaaaaaaaagcaagacccagagatctgttgcctacaaaaaaaccacacttcacctataaagacacacagagactgaaaataaagggatggaaaaagtcactccatgctaaagaaaaaaaaagagcaggagtagctacatttatatcagacaaaatagattttaggaggaaaagtatgacaagagacaaacaagttcaataaagaatgataaaagagtcaattctgaaagagaatctacctgttgtcaatatatatgtatccaacactggaccacctagttatataaaggaaatgttattaaagctaagaaagagatagaccccaatacaacaatagctgaagaattcaacaccccaagttcagcattgaacagatcttccagacagaaaatcaacaaagaaccatgagatttaatctgccctataggcaaactgggcctaataggtacttacagaacatttcatcccacagctgcacaatacacattgttctcaggaacagaccttatggtaggtcacaaaggaatctcaaaacatttaacaaaataaataatatcaagcatcttctctgacctcaatggaatgaaactagaaataaataacaagaggaattttagaaactatacaaacacatggtatatgcttttgaatgatcagtgaatcaataaagacaataacaaggaaatttaaaaatgttttgaaacaatcataatggaaactcaacatactaaaccgatgggatacagtgaaagcagtaataagaggcaatatgttttgactctgcgtcctcaccaaaatctcatgttgaattttaatccccagtgttggaagaagggcttggtaggatgcagtcgaatcatgggagtggactttccccttgctgttctcatgacagtgcgtgagttttcattagatctggttgtttaaaagtgtgcagcacttctcccttaaccctctcttcctcctccagccatgtaggacatgtatgcttccctttcaccttcctccatgattgtaagtttcctgaggtcttctgagccgtgctttctgtacagcccacaaaaccataagtcaattaaacctcttttctttataaattatccagtctcaggtagttctttatagcaatgcaagaatgaactaatacaagaggaagattatagctataagtgtctacaacaataaaagaaggaaaattccaaaaaagaacctaatgatccatcttaagtaactagaaaagtaagaacaaactaagccccaagttagtagaagaaaagaaataataaaaatcaaagtagagataaattgaaatatcaaaaacaatacagaagatcaattaaacaaaaagttgctcttcttgaaaagataaacaaaattgacaaatctttacctagactaactaagaagaatatagagaagacccaaataaatttgagatgaaaaagaagacattgcatccaataccactgaaattcaaagaatcgttagtggctactataagcaattacataccaataaataagaacatctagaggaaatggctaaattcccagacataaaagccttccaggtttgaaccatgaagaaattcaaaacttgaaaagaacgatattgaatctctgacaacaacaaaaaaactcccagtaaagaaaagcccaggacccggtggcttcaccaatatattttaccaaacacaagaataaataatatcaaacatactcaatgaattctgaaaagcagaggagaagggaatgcttccaaactctattgggccagtattatctcgataacaaaaccagacaaaaacacattcaaaaaaagacaactgcaggccaataccactgatgaatattgatgtaaaaatcctcaatgaaatggaagaaaaccaaatttaacaacacattaaaaaatcattcttcatgaacaagtggaatttatctcagggatgcaagaatggttcaacatatgcaaatcaatacatgtgatacatcatgtcaacagaatgaaagacaaaaaccatatgatcatatcaattgatgctgaaaaagaatttgatgaaattcagcaccacttcataataaaatccctgaaaaactgggtatagaaggaacatgcttcaacataataaaagctatatatgaaagacccacagctagtatcatactgaatggcgaaagactagaagtccttcctctaagatctggaacacgacatggatgcccacttcaaccactgttattcaacatagtattggaattcccaggtagagcaatcagaaaagataaagaaataaaaggcatccaaattggaaaggaagaaaatatatccttgtttgcagatgataaaatctaatatttggaaacacctaagactcaaccaaaatatagaactgatttaaaaaattcagtaaatttgcatgatacaatatcaacatacaaaaatcagtagcttttctatatgccagtcatgaatcatctgaaaaagaaattaagaaattaatcccatttatgatagttaaaaataaaataaaatacctagaaattaacataaacaaagaagtgaaagagctctagaaggaaaactataaaacactggtaaaataaattgaagaagacacaaaaatggaaagatattctatgtttatagattggaataatcaatattttaaaaatatccatactacctgaagcaatctacagtttcaatataatcgttttcaaaataccaatgatattctccacaaaattaaaaaagaaaaatcctaaaatttctatggaacaaagcaaaaaatccagaaaagcgaaagctattctaagcaaaaagaacaaaactggaggactcacattacccgacttcaaattatactacagagctatagtgatgaaatggcatggtactggcttaaaaacagacacacagaccagtggaacagaatatagaaacacaaaaataaatccatacattgacagtgacctcattttttacaaaggtgccaagaacataaactggggaaaggaaagatttaatttataagtgctagaaaaactggtatccatataaagaagaatgaaactagaccgttaactcttgctatatacaaaaatcaaatcaaaattgactaaagcttaacctgaagacctcaacctatgaaacttgtaaaaaaaaaaatgggaaaatctgcaagatattggaatttccaaggatttcttcagtaatactccacaagcacaggcagcaaaagcaaaaatagacaaattggattgcatcatcttaaaaaggttttacatagcaaaggaaacaatcagcaaagtgaagaggcaacccacggaatgggagagcatatttgcaaactactcatctgacaaggaagtaacaaccagaatatataagaagatcaaacaactctgtaggataaaatccaataatcaaattgaaaaatggagaaaagatctgaatagacatttgtcaaaaaaagacaggtaaatgcaaacaggtacatgaaatggggctcagtacccttgatcatcagaaaaacataaatccaaactccattgaaataccatctcacaccagtaaaaatggcttttatcaaaaggtcaggcagtaacaaatgctggcaaagatatgaaccctcctacattgttggtgagaaggtacattagtaaaaccactatgaacagtttgaaggttctccaaaaataaaaatagagctaccatactctccagtaatcccacttctaggtatgtacccacaatagaggaattcaatacattgaagacatatctgcacagcaatgtttgctgcagcgctattcacaatagccaagatttggaagcaacctaagtgtccatcagcagatgaacggataaagaaattgtggtacatatacacagtggagcactattaagccaaaaaaaaaatgagatcctgtcattggcaatgacatggatggaagtggaggtcatcatgctccgtgaaataagcaaggcacagaaagacaaacttcacatgttctcacttatttgtaggagctaaaatttaaaataattgaactgatggtgatagagtgtagaaggatggttaccacacactgggaaaggtaggagggggtcaggggagaagtgaggatggttaatggttacaaaaaagagttagagggaatcaataagtcctactatttgctatcacgacagggtgactatagtcaaaagtatttaattatacattttaaaataagtaaaagagtattactggattgtctgtaacacaaatggtaaatgcatgtgctgatggataacccatataccctgatgtgatttattacacacagcaagcctatatcaaaatatcttctgtaacccataaacatatgtacccactatgtacccacaaaaattaaaaataataaaaacaaaacaaaaaaaataaaaaacaagagaacaggaaaggagacatagccaaaactacaattatccaggaaattatcaacactgctctctgagtaaatgatcagaaaattagaaaatgtgtaagaatacggaaggaactaaaaaagaatattaatcaaattgatcttgaaatttataaataagacactccaacagcagaatagatactattttcaagtgtacatggcatattcaccaagatagactacaaaacaacacttaaaatttttaaataattaaaattatataaaataggttatctatccataatagacttagacaaaagaaaacaaagtccaagataatcggagattaaacaatatattttactaaaccgtgttgcataagaattattgaggaaaataaggaaatattttcaacagaatgaaaatgaaactgtagcatagcagagcttgtgagatttagctaaaccagtgcttacagggaaatttatgtcatgatatgcttctgtcagaaaaaatgagtgaactcaaatcaataatctaagcgttcatgtaagaaactattaaaagaacagtaaattgaacccaaggcaagaagagtgatgggaataatgaaatcaaaattagaaaacaatggtgttcagtggaaacaaatctgctctttgaaaaaatcagagaagctgaaatatcagatgttaatccgaaactaaaacaaaacaatattgtgagtagtaatggcgtgggacacagctaaaagtataggaaattgtatagacatagaaagcaatatatcacagttattttcagaaagggcaaaaatgacaagttcttggcagtgctggaaagccaggcaacaaaactgatattcagtgcattgggtataatggggtcaataaagatagattactgtataggaacatgaggaagtcgatgtatgaggaagggccttctggaagctgtgaccatgggaagcctagagtacagtggttggatgtcagggcccaacaccctgagggcatgagcaagaaagaaagctcagtggacaggactctgggattacattctttagttcaagtgtgctgctctatcttccttatattgaaaaattggatttctttccaaggattcaactgaaatacgagatgccatatctaaaatttttgcaaccactgtctaccacttaggtataggatacatcatggaaatttgccctctgagtacctaggcgcaagattgcctccaacaccttgctgtgtttgctatgcaaaatttgagatactgaagagctgttagctgcctaaaaaaaaaaaaaacactaggatagaagagataagtatctgggcattggtgcttataagctcagttttggagagcctgaaaagtactgagatagcagatgtggaattaaaaactcatgctatataactttataatgtgagcaacaacaactgcaagcatgggtatatatatatatatctctctctctccatggctattgttcactcacaaagctccagcctccatgaaagaggtctactacagaggggaaaacatcccagtctctagcaggcagtgagatggtgctgggactgggacacccacaagggtgtcctagaccactaggatagtcaggagatgtagctaacctagaataatgccagggatccagccatgctcatcctgataggacatagagtgattttaaggcagtgtcgggtgttttatatatctatatctatatatagatatagatatagatagatagatagatatagatatatgagtttttctgtctttttatatgttatatacatgatacataacatataaacagatggaaaatttatctaatttgtagaactctaggtgagcattccattcctttcaagtcttactgggatgtattattgttttatgattttgcttgcaaaatcacaaaattattatgtttgcaggagaggagatttcatcccacagcatgtatacttcaatctacacaacacttgatacaggctagcttaatcttcagcccaggaccctcttttgatatcagccccatgtttcctattgcccattgagcagctttacctggacaactagcataacttcattatctacatggcccacggtgatctcatctaccacacccttcctcatctctaccctaatgcaagttgccaccaacttttcttcctttatcctcaatctcagctagaagaaacagcttctacctagtcagtaatcttcagaactcatagccatcacacactaccgcacgatttcacagttcctaatttcctaaaattctctccatctccttaccactttgtcccacccacagcttgaattacatgtcttgtcatttttctttgttttgtcttcttggtgtctttactctgaatgtatttaaaaattgatgaaagaaagaaagaaggaaagaaagaaggaaggatggaaggaaagaagaaaggaaaagaaggaagggagggacggagggaggaaggaaggaaggaaggaatcaaattagcagaagatcacatgtgttgattcaaaatgtgacatctgagctctacctgggtcttttgcttccagagaagaaacctgcagtgccacaactgctcatgtaacttaagaattcccaagagaaactatcactgagcatgtcattatggatttctcatcttaaagcccaaacactatcttggctatggggatgctctcaacagcatgacacatgatgcatcctgctttgcactccacacatacccattagtttaacaagaaagtgtgtgccatcctcataggtttcccatctaccctgcacacgtctgcatcttggtccattcctctatctcagacaatatctggtggcaacgcaggccagcagtgatagccacaggacacccaccctcaatccagggtgccaatagcccagattccaagggaagcactctgaactgaagacatcatttgggctattttccaggcatgtccatccccaacgcttaatctacaaagtcactgagataattagtaccagggtattcccaattaaatctgccctctttgaagctgcacagtgccttccactgaccctcagtgttcctgcctcttcgcttactggtcatcagtaaccaaccccactcactcacaaagccccagcctccatgaaagaggtctaccacagaggggaaacatcccagtctctagcaggcagtgagatggtgccgggactgggacacccacaagggtgtcgtagaccactagaatactcaggagatgtagttaacctagaataatgccagggatccagccatgctcatcctggtaggacatagggtgactttaaggcagtgtcgggtgtcttacacaccactggtcccctccttcagtagacctgcctacccagaccacgttgaagcttacagcttgtaacaaagactcagagattccccaagtctgttcacgtaaactttcctacaatatgttgcattatccctcccacccactcaacacccagatcacaaaactcccaaagaaggaactgcaggttcccaaatccgcagactgcctaggctcaaggcatttatatgtggctcctcccatctggagttttatctccttacttcttctttttacttgttctttaggcattaaaaggcaattcatcatcttccttactgctgctcctagactctaccagtctgtgtgtagggtcttgtttatcctgagatgcccactactaacacaggaccctgaagcgcaaatgcaccattgacgtttagggaattaaggatgcagtgagcatgggctttcatgttttgagatttattaacatttatcctactttcttgagaaacccaagcaaatccatatttaaatatttaattttccagaagaatggacctaaacggataggtgaacccaagactgaaccatcctttacacttttcctctgttattaaatccctatgttttacgactgggatctttcacatttccaaggaaattgctattccagtgctggggaatgttgtactagatcacaataaaagatgacaggtttcccaatttgttttgcaaaatatcaaagctattgttcttaaacttaaaaatatcaataaacgtttggccaatataatttcataaacttgaattctaaagctaatacatcttctattaaaaggaacagcatttcaaaataccaaaaagaaaacaaagataaagctccatgtccaccatacagaggagaaacacaacttgttgcacactgtgtatttaccaggttgaccctcgccctcccctacttagaaccttgactgccctcttcaaacagagttgagaatcaggagaagctgctgaccaacgctgtgcaatgattatgacaacagtactgtccatgggtccaatcctggcccagactctctcttcctcatctctcaaaaactcatcatgtcagcctgaggacaagaggtcagtccctttgactttggctaaaaattctagaactttcgtcttgctggtttcagcctgggctcttggaccacacagaaattcatagcatggaggatcactgctaggcacctatcagtattttaggtaatttgcttgcacccaatctatggtgatgagctttctgagctccccatagatgaaatgctcctttccagcatacatgcccagcatattctggaaatcctagatgtcttccccagaggcaccattaccctctatgaatatcacacccaggacaatgatcaggaggccatttttcagcattctctggctgtcagccagcatctcatcataggtgaggtcccgcgagttaacaaggacataggagtggctgatgcggtccacttccttcatgtcaatgccagagaccacctccaagcacttggaggctcccttgaagggcagggagaaatcagttcttgtatcttttgacaaccttgaacatttccacttttgtgatgggctccttaaatagatacttgagaatcaggaaatatactaaatgagtcaccttcacttctagccggtctctggacaaggattccatgtccgttgagaactacaaggtgcttgaagtctgctcctcttcttggatgctggagtcttcatcaggtgtgctccacgaagtagaggaggaggagcaggagcttggaggactctagagaggaatctggggagggctctggggaggacttggcatcccagaagtagccacatcctcctcctttggagatccaagaatcagtgcagaggaggatgggggggggggggcggggtagaagaggagaagggaaaggagaagtagaaaaaggaagaggaaagggagaaggcttcctcctcctcatcatcagtgggaacctatgcatccaccaagtccttcctatatctcaattgggtgctgaaagtcttgctcaaaagtgaggcaagaatactgcaaaacaaaccatgattattcttatcaggagcagcaggtagaggtgtgagcaggagtgtgagtgttgggttcctacaggcctgggagagaggtggacagtttgaatggcctcagctgagaaatttactcattctgactctgacaaaggttgacttacagatcttttcttacagtgatgctctatggcctcacaggtctcctgtcttgttagaggatttgtctcctagtaggaggacatgagaaagtgcctcagggtgcggctggcaggcaaagcctgaggctccagggctgacggtgggtggggcaagcactgtggggcctcctctgttttgggggtagtgtcttggtatactgttagggtgttatgtcaccttcacttttggcactgcctgggcctcctttgctatatgaccttaggacactgcttcagaccaaggactcacccccatttactggaacccctgtgggagaaacttagccctgtctcccgccaggctgaagactacaaacacaatgactgtgttgtagggttggaggtaccctattgccaagatctctagttccctgatatgtcagtgggccaccataaactaagacctttcagagatgagagcaggtgtgaagctggattctttggggcttcctctatgcgggttaggtgtctctgcagttctccctgagtcctcatctgatgactggcacatcatgggctcctgtctctatccaaagaggacagtgtgacagaagattaaaagaactaatataccatggacaagcctgacaaacaaccttagtaaggtgatagtggtaagtcacattgatactatacactgcaagatatgacatgatgagaatggcacttcacctttgtggctttcctcctgaaagaacataacccacatcgaatcattagaaaaatatcaaacaaattccagtttggggccatctataaagtacacagttatagtagggagtcaggcagacataagcagggcaggagagtcacccactgttagggacaaactgccccaggaagcttcttggtgctacccaccgctccccactctgcaactcctctccgtgctgccccaagcctcttctaagcccttatctaggcaccgtggtgaagccagcagactttacttatcaggcctggctgctataaagcaaaccccaattacaaaccatctgaccgcacagggggaggttgtgggaagcataaacaaactttacaccctctggtaccataaacgtcacaaggtgatttgtggcagaattaaccagcaaacaaccctgggatgcggccataccaaagaattccctcaaactccctctccaatataaacccctcattctgtaaactggttgctgctgcctcctttgtctgtggtaaagcagccggcaggtttaataaaagcttgcctgaacttgggtcttgctctctctctcgtccttactctgggctgaccttacacccaccacccaccaggaatgtctggaaaccatcaggtgatggtcaggcagttgctaactgcgtctctaaaataattggtcgcagccagtgccagggaaaggcagtcctccaatagatagaaaacatctgaaactggtgattagcagcttcccgataagaccctaagtcaaatggtcaaaccatgcacttgatctctcaagttgcccacctggccctcttccaagtgtaatttacttctttcattcctgctctgaagctttttaataaacatccactccttctctaaaacatgcctcagtctttccttctgccttatgcccctcagtcaaattatttcttctgaggaggaaagaattgaggttgctgcagacctgtacagattcaccacgaggtaacaacatgatcagtactcctcaaacatatgaaagtcaacaaaatcgagagaagtctcagcagctagcacaaccaagggaagtctaaagatacatgatcactaaaagtaatgggggtaatctcaggggataaaaaaaaaaataacacggggtgaaaagtaaggaaatctgcataatgtatggatatttgttaataacatgtatcaatattggcttattaattaatagagctgtatcatactaaggtaagatattattaataggaaaaactgagtgtgggacatcatcactatcattgcagttttctggtaatcctaaaacaattctaaaatgatgtggaggttaaagtaactccatcttggaagctaatctgccatgttgacttctcctcaacccaggccttggggaatgcctctgagatttcaaatttatctattgtttcttttgttgtacttaccaaaaattgtgcccttagagcaaatcaaccttgataaactcctacttactgtaaaccatggctttggccttaggtaaattcccagccattctcccagaagtacatgtgcccctcccctatgttatgtagccactaggtctgggaggttattgttcagagacatacctgtcttatggctgcccaagaccgtgcttctgtccatgagttcccccaataaaaccaaactaaaatgacaagctggacttgtctcctcctttcttgtattttttttttttggctttctctacatttgggggttttcttacatatactgccctttcatagaacaaatgaggtttatgaaacttaaaatgttggcaaactccataaaggatatgtatgaaatacctaccacaagcatcatacgtattgagagaaagttgaaagcttctactttgaccttgagaactaaactagggttcttgctgatcatcatttctattctgtgtaatagagtgtaacagagatagtagccagtgcagtaatgtaaagcagaagagataaaaatgagagcagtcagaaagcaagacacaaacctttcaatactaatagatgattagactgtgtatgaaaaacactcaaaagaactaacaataagctttttacttttctaaaggaagtataaatttaccatgtctttatgacagaaggtagtttcttcttttcatttccaacttttatgtgaggttcagggtgtacatgtttgggtttattatataggtaaattgcatgtcatgggggtttagcatacagattattttgtcacccaggtaataagcatagtatctggcaaatagtttttaaatcctcaccctcctcccaccctccatccttaagtaggctctggattctattgttcccttctttgtgtctacgtgtactcagtctttagctcccaattataagtgagaacataaggtatcggttttctgtttcctcctcactttgtttaggataataagctccagctccatccatgtagctgcaaaggacaaaatggcatttggggtctgtctttcatatacagccctgtatcattctattttagggctgcctattattccatggtgtagatataccacattttttatgcagtccactgttcatgggcatttagcttaattttatgtctttcctactgtgaatagttcacaatgagcatactgtgcatctgtctttatagtagaatgatgtatattcctctggggttataccagtaatgggatttctgggtcaaatggtagccctgttttaagttctttgagaaagctccaaactcctttccacagtgcctaactagtttacattcccaccagcagtgcttcagcattcccttttcaccacaatctttccagcatctgttattttttgacttttcaataacagccattctcactggtttgagacggtatctcattgtggttttgatttgcatttctctgatgattagtgatgttgaggctttttttatatgcttgttggccatgcgtatgtattctttacagaagtatctgttcatgtcctttgcctgatttttaatggggttgtttgtttttttgttcattaaagttccttacatattctttatattaaaactttattgaatgaatcctttgcaaatatttccttccattctgcaaattgtctgtttattctgttgatagtttctctgtctgtgcagaagctctttagtttaattaggtaccatttgtcagtattttattttctgtttctgtgttagtttgatgaggataatggcttcctctttcaaccaagtccctgcaaaggacacgatctcattctttttatggctgcatagtatttcatggagtaaatgtaccatattttctttatccagtcgatcattggtgggcattaggttgattccatttcttttctattgtgaatagtgctgcaatgaacatacacatgcatgtgtctttataacagaattacttatattcctttgggtatatacccagtagtgggattgctgggtcagtcgaatggtatttctgtccccaggtcttcgagaaattgccacactgtcttccacaatgactgaactcatttacactcccacgaacagtgtaaaagcattcatttttctccacgaccttgccagaatcccttattttttgactttttcttaatagccattctgactggtgtgaggtggtatctcattgtggttttgatttgtatttctctaatgatcagtgatgttgagctttttttcgtatgtttgttggctgcatgaatgtcttcttttgagaagtgtctgctcgtgacctttgcccattttttaatggttttttgtcttgtaaatttgcttaagttccttgtagattctggatattagacctttgttggatggatagattgcaaaaatattctcccattctgtaggttgcctgtacactctgttggtagtttcttttgctgtgcaggagctcttcagtttaattagattccatttgtcaacttttgcttttgttgcaattgcttttggcattatcatcatgaaatctttgcatatgcctatgtcttgaatagtactgcctagatttttttcaaaggtttttatagttttgtgttttagtctttaatccatcttgagctgatttttgtatacgatgtaaggaaggggtccagtttcaattttctgcatatggtttgccagttctcccagcacaatttatcaaatagggaaaacttttgaattgcttgtctttgtcagatttgtcaaacatcacatggtcgtatgtgtgcagtcttatttcagagttctctattttgttccattggtctatgtgtctgttttcttttttgttgttgttgttgttctttttatcagtattatgctcttggggttactgtagccttgtagtatagtttgagtatgattcctccagctttgttctttttgcttaggattgtctgggctattcaggttctttcttggttccatataaattttaaaatactgatttctaattctatgaagaatgtcagtggtagtttaatgggaatagcattgaatttataaattgctttgggcagtatggcgattttcacaatattgattctctctatccatgagcactgaatgattttccatttgattgtgttatttctgacttctttgagcagtggtttgtagttctccttgaagaggtccttcacttctcttgatacctgtattcctaggtattttattcttttcgtttcagttgtgaatggtatttgattcatgatttggctctcagtttgcctgttcttggtgtataggaatgctagaaatgtttgcacattgattctgtatcctaagaatttgttcaagttgcttatcagcttaagaagtttttggcctgagacaatggggttttctagatataggatcacatcatgtcatcttcaaacaaagatagtttgacttcctctcttcctatttgaatacctttatttatttatcttgactgatttccctggccagaacttccaataggatgtggaataggagtggtgagagaggatatctttgtctttcggtggttttcaaggggaatgcttccaccttttgtccattcattatgatattggctgtgggtttttcacgtatgactcttactattttgaggtatgttccttcaatacctagtttgctaagagtatttaacatgaagggatactgaattttattgaaggcctcttctgtatatatacaaataatcatgtggttttaatctttacttctatatatgtgatgaatcacatttattgatttgcatatattgagacaacgttgcatcttggggatgaagcctacttgatcgtggtggataagtgttttgatgtgctgctggatttggtttgccagtattttgatgaggatttttgcattgatgttcatcaaggatattggcctgaagttttctttttttgtcatctctccaccaggttttggtgtcagaatgatgctggtctcatagaatgagttagggagtaatccctccttctcaattttttttggaatagtttcagtaggagtggtaccagctcatccttctacctctggtagaattcagctgtgagtccatctggtcctgggcttttttcagttggtaggctatttattacagtctcaatttcagaactcattattgatcttttcagggattcaatttcttcctggttcagtcttgggagggtgtatgtgatcaggaatgcatccatttcatctagattttctagtttacgtgcatagaggtgtttataatattctctgatttatctgatagttgtttgtatttctttggggtcagtggtgatatccccctaatcaattctgattgtgttccttttaatcttctctcatttcttttttattagactagatagtgatttatctattttattaattttttcaaaaaatcacctcctagatttgttgttttttaaggggttttatgtctctatctccttcagttcagctctgatcttggttatttcttgtcttctgctagatttggggtttgttttctgttggttctctagttctttttgttgtgacattagattgtcaacttaagatctttctagctatttgacgtgggcatttagtgctataaatttcctgttaacactgctttcgctgtgtcccagagattctggtatgttgtgtctttgttttcattagtttcgaataacttcttaagggggtggagccaagatgacctaataggggcagcactgctctgtgactcccatcaagaaggacaaaaactgtgagtgaactctgcatcttcagctgaggtaccaaagttctcttactgggactgaataggtggtcggcacaaccatggagagtgagcaataacagggtggagcaagaccccacccaggagctgcaagcagcaaagggaactccctcccccagccaaggtagaaggtgagggattgtgtttcccctccctgaaaaccaggcttttcccacagatccttgcaacctgcagaccaggaggtcccctcctgagcctacgctaccagagtcttgagttacaagcacaaagttgtggagaatcactgcggatgcttgggtatgtggccgctttgagcaggcactgagacacaggagtatttgcgttctctggctctaggaacttccctgaggcaagagatccatcctctctcgttgggagggggctgaagcccgggagccaagcggcctcactcccaggaaactccacaagctaaatcccactggcttggaaaccccaccagccagcgtatccggctagaaactgcctaagaagaccaagttcttggggtggaagaggcagacaccatcactgcggctccagtcagccgctttcccttgctgtgggtgccagcaagacagggaggtccagactgagagcggctccctacagcgcagcacaacaggtggaccagttcgtgttcagactgcttctttaagtggactcctcctcacagggcggggcctctctgtggaaatttccgcatccctagccaggggttttggacagaacactgataaccctgagaggagtccctgggaggaggagcagctgtggtatcatgtgtcagtgatcttagtcttttctgcctgctagctctggagagtcagggaagaccagatgagggggattccctgcagcgcagcacaccttatttcaggaaataggcgcgggcatagatttcatgatgaaatcaccgaaagcaatgacaacaaaagcaaagtttgacaaatggaatctaattaaactaaagagcttctgcacagcaaaataaactaccatcagcatgaacaggctacctgcagaatgaaagaaaaattttgtaatctatccatccaacaaaggtttaatatccaaaatctacaagaaacttaaatttacaagaaaaaaaaaacccttaaaaagtgggcaaagaacatgagcagacacttctcaaaagaagacattaatgtagccaacaaacttatgaaaaaaagctcatcactgatcattagagaaacacaaatcaaaaccacaatgagatactatctcaggccagtcagaacagccattattaaaaagtcaagaatgctggagagtcaagaatgcggagaaataggaatgcttctacattgtcggtgggaatgtaaattagttcaaccattgtggaaaacagtgtggcaattcctcaaagatctacaaccagaaataccatttggcctagcattactgggtatatgcccaaatgaatataaattattctattacaaagatacatgcacacatatgttcattgcagcactattcacaataagaaggacatgaaatcaacccaaatgcgcatcaatgatagactgaataaagaaaatgtggtacatatacaccatagaatactatgcaaccataaaaagaaatgagatattgtcctttgcagggacttggatgaagctggaagccgttatcctcagcaaactaatgaaaagaacagaaaaccgaacaccacatgttctcacttataagtgggagctgaacaatgagaatacatggatactgggagaagaacaatacacactggggcgtgtcggagggttggggtgggagaagggagagcatcaggaagaatagctaatggatgctgggcttaatatctaggtgatagggttatctgtacagctaatcactatggcacatgtttaactatgtaacaaacctgcacatcctacacatgtacccctgaacttaaaataagagttggaagtaaaaaaaaatgctgaatataggtccccagtctcttctggcttgtagagtttctgctgataggtttaccctgatggggttacctttgttggtcacctgccccttctctctagctgcctttaatattttttccttcatgttgaccttggaggatctgatgactatgtaacttggagatggttgtcttgtacagtatctctcagggcttctctggattttctgaatttgaatgtcgaccagtccagcaaggttagagaaatttttgtgaattatatcctcaaatatgttttccaagttgcttattctttctctatttcagggatgccaataagttgcagtattggtctcattacataatctcaaatttcttggagattttgttcattatcttttattcttctttctatatttttttctgactgagttgattcagataactggttttcaagctcagagattctttcctctgctgggcctattctgttgttaatactttcagttgtattataaaattacttcagtgagttttttagccttatcagttctgtttggtttcttctcaaaatggtgatttcatctttcagcttttctatcattttattggattccttagattatttggattaggttttgactttctcctgaatctcaacgatctgtgtcgctatccagattctgaattctatgtctgtctttgtagccatttcaccctggttaagaaccactgctggagaactagtgtggtagtgtggaaaaaaagaagatgctctggtttttggagatgctatagttcttgtgctgctcctttctcatctgtgtggacagatgttccttcattagttgaagttgctgtactttggatgtttttttttttcttttctattccttgatgccctagagggtttgttgtataaggtgggtttagtcaactagcttcatttctggaagattttagaaggcaaaagctcaggttaatactcctggtctgcatgctctaactggggactggtaccaggcccacatctttgttctctgtccccttgaggttaggcaactgctatgctagaaatgctgaggtgctccttgtccaccggcaacaacactctgatggcggttgctggctaaagtgtttcagtggggcagtggcagcagcgtctatactcaaatgggcatacaaccagcaacagtggcatggctaagattatcaatagatgaaaatatatgtttcctatgtataaaatcaataacaaaaaaatgaactccattttcttgcggcaacaataagtatgataatgaaagtaaatataacttctaaactattataccaaatatcaagtatcttaaaaaacttaaccaaaataaaagttacagaaaaaaaaaaacattaaaatgttattttaagatactaatgaagattcacatgaccataaaataaaataaattcgcggccatgaagtttcaatagttctcccaaagaaggaatccacagattgattgcaatcccaaatcaaaacaaccaaagggctttagacataaatgcatgtattaatcacctgattctaaaatatgaaggcattcagaggaccacgtatagtcaatacactattgaaaaagagcaataagtctaccagatattaggaattacaaagaaactattgcaattaagagtttgagatttaggtgcagggattgacagaccaatggaactgaatggagagtcctgaaaaatgaaaccaacaaaacatgtataaacgcacacttaactgataaaaaaaaaatgtgcagctctagcgcaagagacagtcttgttgaaataagtgtcattggaacgcctgaatatccatataaaaactctagtgtaagtggacccctttttcacgctatacacaaaaggcaattacagacaaattcaaaacctactttaaaaatgtttactttttttgtttgtttttgttttgttttggtaattttatttatttttataaattttaaatgttgtgaaatagtctagtttagaaaatgtacactttcccatgttgataatggctatatttttgccctaggttttgtgagagagaacgagagagagagagagtgtgtgtgtgtgtgtgtgtgtgtgtttgagagagagagagagagagagagagagagaaagagagatatgaaatacttggtgtttcctagtcctttttatcaacaagtacaatttattcactgagcaaattttcagagtttttctgtggaatacaattatacaactgtttgcttgcttttaaaataactggagttattttaaaaatagagctgaccatggggtaaaaaaactgaacaaataagcagaaaatccaagcaataccaagtgagtgctctcatgcccataaaaacaagtatttcaacatggcctggtgggatgggcagaacatctgatgaaattaaagaatcatcagttttgtgagggtgtttataacttttccttcttgttcttcatgaaaacttgagattttgtagtactttttaataggtaaagttgtggctcatgtttcatagtttacataggtaactttatcaacatttcacagttagaattttcatattataggcatatttcattttttttgcactttgctttatcacacctcacagatattgtgtgctttttttttttttttgagacggagtcttgctctgtcacccaggctggagtgcagtggagcgatcttgactcactgtaacctccgcctcccaggttaaagcgattctcctgcctcagcttcctattaaaaaaatcaaatatacacaaacatacatgaaaaaacaaataagactttgtatagatgatcttttagtgagtcagcagtaagagtaaattagagcatcagtaaggctagaggtgaaagaactgaaacaggctggggtcattggtcacaccagtaacagaaggaaacaagatgatatgagtcaaagaggaagagatgaaatggcagctctttctgcccccttgtcccagccatagaaggctttgctactttaatgagcctttgctttctgagagcaggatttgggaatcaatagtggctggggaaatgctacctgggataatgacatattaattccccctctgacttgacccatcctcctgctgacctctggaactctggggatctaagagatgtaactttagcagctctattccagaaagtcatgacagagggatgtcgtgttgatgatagacaccctgaccaggtccacaaacactttcctgacataatggctgtgccaggttgcccacataataggagtagaggcctgtctccctctccacatggataagagctccacatacttcctttcagctgttcttactcctgacagagccctcagaaggattgaggggccctgagattccaaaagaggttgacatatggctttgccagagatttcactgagggttgggcttctctccatccactatggccaggatcaactcagccgttcatgagctgatttccttcctcagctttggctcaaggtcccaagggcagttggcctctgctcacagccaggattggtgtatcaaacctcagtgctcaaggtggaaacccacagagaaggaagatcttccagactgggaggcagctggtaggctgagttccagctctgggccccatgtccttggaaattatccacatggagttgttcttctgaggtcccaagaaaggagcacttcttatggaaggtgaaaagaaaatggcagtctatcattttacctactgctattggaagtaagtctcctgtccagaagcaagaggcactaaggttcttgtgatggcatcagtggggcgtgtcagggacctttgaaatgagtgaacacaaccattctctaaacatcccccaaatgactcaccttcagtcccttattctcactttagattcatccttcagtgaacatgctgcttctgccagtgaaggtgtaccatagttgccatgaatatagaattgttgggcacagggttgcaggaagggagggaattcccagatttcaaagaagaagaaacatttgtgcatgtttctgacaggttacaaaatacacatgaaggctgacaaaaaattgaaagaacaaagtatggctcaatttgatttttgttaacatcaaagatggcagagtttttcctgttgtgcttgatgcctacatttaccttatcccaaatcaaaaccaacagcaactttgttccttcaactgctaaaatccatttcaaatccttccactttttcaatctccattactactgctgtgtgtgaagttaatattttctttcacttaggctaggctaaaggcgcctttgttgttgctactttttctatcattgtccctgtaaaatccactgtcttttcagcaggctatgatccttttgaaaatccaatccatgacatagatggagctggaggccattatccttagcaaacacaggaacagaaaaccaaatactgcatgtacttacttataagtaggagctaaatgatgaaaacaccatgaacacataaaggggaacaacacacactagggtctttggcgggggtggagggtgggaggagggagaagatcaggaaaaataatgaatgggtactaggcttaatagctgggtgatgaaataatctgtacaaatatccctatgacacaagtcgacatatgtaacaaacctacacttgcatctctgagtttaagataaaagttaaataaacattttaaatacatacatcaaatttaactgctatgtaaagctttatttatttaggcaaatgcatggaggtccacatctaccattcaagtattataatgatgagttcaatcaacctaaaattccactgtgcattccgtttgaggtcaaacactgcacttctccaaagtccctagcaactttgctctgttttcagttcctacggttttaactttccaaatttgtcattatgaataggctgataaaatactgacttataaacctagctgtatcatttttcatcacaaatagcagggaacgagaattcctgttgttccatatccgctcatatttggtattttagattctcgaattttagccattctaataagcatgtattggaatcttctttagtttttgtgtgcatcttcctaataacaaattatgttggccatctttttatattcctctttctgaatggtatatcctctttgctaaagtatctgttcaaatgatgtgcatatttctaaaaactaatagacttcatttttagagcactgttaatccaaaaatataaagagaaaatttcagcaaaagaaactaccatcagagtgaacaggcaacctacagaatgggagaaaatttttgcaatccactcatctgacaaagggctaatatccagaatctacaatgaactcaaacaaatttataagaaaaaaacaaccccatcaacaaatgggcgaaggatatgaacagacacttctcaaaagaagacatttaggcagccaacagacatatgaaaaaatgctcatcatcacaggccatcagataaatgcaaatcaaaaccacaatgagataccatctcacaccagttagaatggcaatcattaaaaagtcaggaaacaacaggtgctggagaggatgtggagaaataggaacacttttagactgttggtgggactgtaaactagttcaaccattgtggaagtcagtgtggcgattcctgaggaatctagaaataccatttgacccagccatcccattactgggtatatacccaaaggattataaatcatgctgctataaagacacatgcacacgtatgtttattgcggcactatttacaatagcaaagacttggaaccaagccaactgtccaacaatgatagactgaattaagaaaatgtggcacatatacaccatggaatactatgcagccataaaaaaggatgagttcatgtcctttgtagggacatggatgaagctggaaaccatcattctcagcaaactgttgcaaggacaaaaaaccaaacaccgcatgtcctcactcataggtgggaattgaacaatgagaacacatggacacaggaaggggaacatcacacagcagggcctgtcgtgaggtggggggagggggagtgatagcattaggagaaatacctaatgttaaatgatgagttaatgagtgcagcacaccaacatggcacatgtatacatatgtaacaaacctgcacgttgtgcacatgtaccctaaaacttaaagtataacaaaaaaaagaaagaaagaaaagaatcatcttaccaagaaaaaaaaagaaagactggattttttgaaataagaaactgtgctttgttacagaaaatagagtttttgtgcttaaaatccaaactatgttggtgttggatctttgaccttccaaatccacctaataatgatttgcactctgactgcaaaaaaaaaaaacaaaatttcataaaaattacagagttcctacatatgtacaccactcttcctgccctgcccacttcacacacacacacacacacacacacacacacacacacacacgcacagtgtctcctatgatttatattttgtattattatggcatgtttgctacaacagatggacctgtattgatacctcattattaagtaaagtcaacagctcacatctgggctccctaactttggagatgttaaaagttttgataagtgtgtaatggcaagtattcatcacagtatcacaatgaattgtttcaccatcctagatctcctgtactccacctatttcttaatcccctgtgcctcaaccccagccactaaggccctggaaaccactactatttttagtgtattcatagttacctgttccagaatattgtatgattgtaatcatacattatgtagcctgtttagattttcttctttctcttagcaatatgtttacatgattcctccaggtctttcccacttaaacaatgcctgaaagttcctgttgctcaacatatgtgtcaacatttgacatttcagtgtttgggaattcagccattctcctgggtgtagagtgctatctcctaggtgctttaatttgcaattctctaatgttatatgacattgaacagttttattatatacgcttattttccattcctatatatttattttttggtggggtgcccgttccgattttttttttttgcctactttaaattgggttttctattctctgatggctgggttttcagagttttgtgcatatttgaatacatatattttatcaaacgtgtttcacaaaacatttatccaagtttctggcttgtcttttcattatcttagcagtgtcatttcagagtagaaatttttaattgtcgtgaagtccaatttatctcttgtttctcaaatggttggtacttttggtgttgcatctgagaaagtcatcataaaactcaaggtcacccgggatttgcatctataagtttgaccaaaacgttgatgttgcatctacaaaattcatcaccaaaaccaagtcacctagggtttgcacccataagtttgaccaatatttaaaactgtgataaaatacgtttgtgaataaatggtttccccatagacaaaaatatgggggaaattaactggttaaacattttggggaaaaagccaccaacattatgaagtataagatattcatactctgttcacactgactcagtttccatatgaatgtgcattccttataaggaactataggcatttgtcccagaatttatgctcaaatatgttgaatttatttattttaattatagccacaaaagagaaacacgtgtgtgttcatcaggaggaaaattgttcaattggttattgcacagaaataaaatggaattctaggaagtagtcccaatagtgagatagatctatatgtgttgtcatggaaagatcttagtctgtatgtgctgtcatggaaagatcttagatccttttttttttttttttttttttttagcagcagagtttcactcttgtcgcccaggctggagtgcagtggcacgatcagggtttactgcaacctccgcttcccgggttcaagcaattctcctgcctcagcctcccgagtagctgggattacaagtgtaagccaccatgcccagctaatctttgtatttttagtagagacagggtttcaccacgttggccaggctggtctcgaactcctgacctcaggtgaggagttccacctgcctcggcctcccaaagtgctgggattacaggcatgagccaccgcgcccggccagatccattttaataagtgattatgttggtttattaggactgccatagcaaagtaccacaacctggatgacataaacaacaaaaatttattgtctcatagtttgggagtctggtagtcaaagagcaaggcattcgcaaggttgattccttctgagggctgtgagggaaggatgttttccaggcctctctccttgccttgtggaggcatgggctgtcttcagtccatgcgtgctcattgtcatccctctattcatctctgtgtctaaatttcccctttttataatgactcccatcatatttgattagggccagcattaataacctcattttaacttaattgcatctgaaataattctatctctaaataatgtcacattttaatttcaatgtagaatttgggagaagatgaaattgaacctataatagtagcaaaggcaagcagcagatctatatgcatattattacacatgtatagttttatatgtatacatgtatatatatatacacagcatatacatgtgtgctattatatataatatttgcatatatatattagcacatctgtatttctaaaagcctaaaataatcttttaaaatttacataccacattgttaattgtggaaacttctgagtagggggctgaattttggagaaactttctaaaggaaagaaatgtgatttctatgtattttaagaaatttttgcaacaagaatatatgcagtatttatttagaagaaaaaatattaaagtaagtccaagaaaaggaagaggagcagtgtagtagtcagataaagtaacagtaagctgatggaacaaaaaaattgctgaaattaaaatggcttaacccaagtttatttttgtgcacataaattctaacctgagttgacatggtgctacgggctgaattgcagctctcttcccaaattcatttatccaggtcataacccctagtacctcagaatgtcactgtatttgaaggtagagcctttgaagaggccattaagatatagtaaggtcttataagtaggacctgattcagtatgactggtgtccttataagaagaggagattaggacacagacacaaagaccaagggacaaccacataagaattcagtgagaaggttgtcatctgcaagccaaggagaagccacagaagaaatcaaactggccaacatattgatcttggataatccagcttccagaaatgtgagaaaatacatttccatttttaagtcacccagtctgtggtatgttgttatggtataataaactaatacacagtggatcctggctctcatgtcacccaggaatccaagctgattttaccccatagctccaaatcacaacatatgttaactcttaaacagacatgaaagcattcgaatgatgcactggcttctgtctaactacaaatgaaccactcaggaagacaaggtagacaaaaaagcgatgggcacttgtaatctctcccataagccattatggtgcttaattaaaagcagcttttataattcatgacagtaagtcttttattttattggaatggtttatgggaatgctagcattgccttgaaatcttccaacttattcttgttcttatgaggtgactggcaatttgaaatacaggattacatctagctttaaaacaattccttaagtcttggcagggagggtcaaccttattccctcaatagcacttttctgcactgtcctttttataacctatatgatttctttaggctgaaaattttctcattcattttggtgtatgacaaatatcctactctgagagcctctgcttccctccacatgactaaacatttctgatcagctgtacatgtgcctgtggcatactgcaaaccaggattttcctgcgaggcagatatacagacaagagagagaggaaagatggttaaccattgttggtttttctcattagagctagcatctctgccacggaacccttgtcacctcctaggcagtctttgtgattttgttattattttgtttttttaaaaaaaattcagcttccagtagatcatttacaaagtgattttatagtctttcttcatctacaaagattatgaaggaaacgttggtttttgatcacctatgaaagctcattcaactatgtttgggttcagtgcactgtttcaaataatgcctcgtattaaaatcctaccacaaatatcacatgttaggattctttcaaataccctatctctgactttagagttacatctctaaaaccagtatattatgtggcaaatcagattctactcaccggtctatgtggaaatacattgagagtgtgttgaagatgcccagggtaagtattgaaatgtcactatccaaagtgaatagtcacatcgaagggctgttatcacagaggactcagggggagggatggatgactcagggaacttctgcatggagtaagaatggtctatcttggggaagggcaggtgattcagggcttttgcattgggagcagggcacagcattcagagggagagacactagtgacaagctagtcccctggacaagagaccatacagggaagatcaaaaggacagtgctgtaatgtgggaaagtactggggctggacaaaactgccagcacctggacatagtcagttctcaagaaaccctgggcttagaacaggaggactttaggtaaagaaagccaataatgatccctgaattgtactttattctcattatcacaccttcattctttaggcctaacttacaactttggccacagggttcatctttatgttacttgagagacattaagaagcgtgaagagaactgacttagattaaaggctgtcctcgggctgggagaagtggggacagtgtgggcctagatcaaattcagggcagggctcaagtccgagtcactttctagcaatgtgatattggggaattaaataagagatatgagccttcctcaggctgggaatagtggggacagtatgagtctagatgaattcagagcaaggctcgagtcccagccctgtcactctctagcgatgcgatcttgtggaatttatcaaaccctatgagcctcaggtttttcatctgtaaaaggggcttcataagccctgccttgtagaattgctggaatggatgtaatgtgagtaaaacacctggaacaatgcctgacatatattggaaatttaacaaatggcagttgttatcgatatgatcataaccccaaaggctaccactgtcttttgtgaaaattcagctgtttttgttatccaaaatatgtcagcatatgtagttgaatatgtcatggagtaccaactcaaccaaaaattcagcttcacaaataaaactcagcacattttctttctgaaatgatatattgtataatttgggtaaggggagaattccccaggtggaatgcaactcagtgatcctagaatttgagtcaaggaccaactccttttcatcttccccaatgctcgtccatccaaaccactacttttatttgtcctccactcaaaatagcccttgctgagagttggccaacttacattcaaaataacctaattaaatgtcctttctatgaagtgggctctggctctcctaggccagggaagtgagtgccagcctagagtgttctgggaagcacttcaagggattatcattctatttctcaggaaacccttgcagatgatgggtatcaatcacctagttcttgcaccgcgttcaagctcaccagttagagagctgcaggacaccttccattacttccctatgtggagactcctctctgcctcatcctccacccagaagcaactgctcagagcaattttccattccacgtttttctctcaccttctgagagtctggttgctgccaacacccagcttcataacaatcagctcccacagaagcaactgcagttttccaaagccccaagctgccttagctcagggcctttatactggaaggctcacattggaatctaacctccccagtcctttttttgttttgttttgttttcaattataagtttatttaatttaacaaataatatattcatatgatctatttcttctcaaaggtggttttgtagtttgcatctctcaaggaaattttcaatttcgtcaaagttgtaaaacttataggcatgaaatttgtaataatattcccttactgtccttttactatctgaaagctctatactggtattcctatttattttactcctgacataagtaaaaaacttctacttttttttctttttctttttttttcttaaatgataatggcatttattatttcacataagaggaaacctggacatacataagcttctggatgggtttatccagtacttcttttttttattattattatgatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcacagtgtgatgttccccttcctgtgtccatgtgttctcactgttcaattcccatctatgagtgagaacatgcggtgtttggttttttgtccttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatactaaagaacaaagctggaggcatcacgctacctgacttcaaactatactacaaggctacagtaaccaaaacagcatggtactggtaccaaaacagagatatagatcaatggaacagaacagagccttcagaaataacgccgcatatctacaactatctgatctttgacaaacctgagaaaaacaagcaatggggaaaggattccctatttaataaatggtgctgggaaaactggctagccatatgtagaaagctgaaactggatcccttccttaccccttatacaaaaattaattcaagatggattaaagacttaaatgttagacctaaaaccataaaaccataaaaaccctagaagaaaacctaggcattaccattcaggacataggcatgggcaaggacttcatgtctaaaacacccaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaatgggaacacttttagactgttggtgggactgtaaactagttcaacccttgtggaagtcagtgtggcgattcctcagggatgtagaactagaaataccatttgacccagccatcccattactgggtatgggtatacccaaaggactataaatcatgctgctataaagacacatgcacacatatgtttattgcggcccagtccttttttaagttgttctttaaattgtaaagagcaccttaccagcttcttgatatggcttctgctccaagaatctcctgttttatcagtagggataagtcatgcttttcacactatccgcactatgaagagtgccttccaaaagcatatgcttaaataatgttcagcaaataaaggagtcagtgaggctttcttgtattcagagttaatttctgctacttttttgaatatgccaagccaagcaagggatacatatttaatttttaagaacaagaaaataaagggtatgaggagatgcaaatattagccatccttcattttgttcaactattgaactgctgagtactttcacttttaaagaaaattcctattataataccacactatcctgttacagatcacaaaataagagaaggttttcccatctttttaacaaaatataaaattcttacttttaagtcagataaatggcaatacgtaaataatattaataaacgaagattctgaaaccaattaaacctgctattaaaataaaagcatttgaaaataaccaaaagaaaaacaggtaaatctataaaccacccacatgaaacagaaatgcagagaacgctgttttctctccagctccacctgggcccttcactatgtaggacctcaactgccttcttcaaacacaaagggaagaaactaccccagacttcattcaggacaggagaagttgctggacatgaaactgaagcttgcactgggcatggcagtggcatcatctgtggtggaaattatggcctgggctctctcttccacatctttcaaagcatccttgtaccaggatggaaaggaaatagggatactattgtatagcttggccaaaaactctagtactttctgcttggtgctttctgaatgggctcttggaccccacaggaattcataacgtggaggagaactgttgggcacctcccaatactccaggtaatgttcctgcacccaaactttagtgaggagctccctgggctccccatagacgaagtgctccctcccagcatacacccctattgccttcagcacttcccagatgacctcctcaggggcacagctgcccgttatgaagatcacactcagaataagaatcaggaggcagttctcaggcctgcccgtgtcatcactaccctcatcggcgaggtctactgtgtttgcaaacacatagaaatggtcagggcccacttctatcagggaaaggccaaaaagaagctctatgaactcacaggctttctcgagtatcacaggaaagtagtctttgtacttggtgatgacaatcgtcagcatctctgactctgttataggctcctttgtttgatatttgaggagcaggaactccactcactcggccaccttttcatctagtgtatatgtgaaaaagaactcactgtctggcaggccaggacaggtcctgcatcctcctctttttggctgctggactcttcattcattgggctgcatgaaacagaggaagagcaggagctcagaggattctggggaggacattgggaaggaccctgtggaggactcttgggagtgctctggagaagacttgacatcccagcagagtgcacctcctcctcctcagggccaccaagaatcagagaagaggatgaggaggaggaagaggaggaaaatactaagtagaaagtagaagaggaaatggaggcttcctcctcttcctcatctgtgggatcctgtgcatctatccaatcctctattacaactgggtactgggagtcttccgcaaagttggggaatggaacgcttggaaagagaggcataacgacttcttcaggagcagcaggtaaacatatcaacagggatacggatgatgggatccaacaggcctgtggaagagagtgacgctgtgcgtggcctcagctgataaactcacccatgatggctctgccaaaggccgacttacagctcctcttctcttaaggtcgtgcttcagggcctcacaggtcgcctgtcttcctagagagattgtcccctgggcacctgtaagaggatgtgagaaatcacctcagggtacagctgaaaggcggagcctgaggcaccaggaatgacagtaggtggttacggctgggtgctgaagagtctcctctgtttgtaggggtagagcctttgtaacaaagttagggtgtgcactcaccttgactcctggcacttcctgggcctcccctgctgtgctgactttaggaagtgcaactcagacccaggtcttcacatcctggttcctggagcacctgcaagaggaagtgagggagcccctcaggctaaagactgcaagcagagccttgggtctcccagggctgacagctggggctggccagactcacagagctccatcgttctgggctgcatggctccctcagaatttaattagcaacctcacagcttcttagacagggccagacccccaccactctgctggtctgaggcaaaacctcagagcaaattccacatccctgagagcagtgggaggtggtgcggtggcagcctctgccaactgccaagcggaggcagctcccctgctgacttgccatgggacccccagaccaaggcctcccccctcccctccacccctcacccagaaatgagagggctgcggctcagcctgagctgactggggagctctaagagggctgatacgacgagcagggtgggaatctccaggaatctgtcctctgaggtgggggttccccgactcttcctcaaagtcttcctatttattccctagagggccggcacctcctcccttcttctatcgtgaggacccctcagcccccagcggccattttcctctctgggacctacaagtcccacggcaggggcagcacccgctacggtttcttctctctgtggtgggagttcgctcagttcttcctcagggcccttaccttgaggattggccaggtctaagacttctctctgctgaactgagacgagcctcctcacaaagtgcctcatgtccttcggactcacaaaatgcaagtcgggaaagcacatccaggaaccctgccggggttgaccagagctgacagcaggggcagcgtgtggcggggcctccactctgcagaggagccaacccccacgtgtcagtctccttccaccctttcctgaccacttcctggtcgccctccaccccttcctgctcactccctaagccttgctgacctcttccctcccacctccccagtccctgacaccctcctcctgccccttttcccagggctgacagcagggagtgtctctttgcagcctgggcctcccctccctggtgggaggtcatcgtccttccacagagttctcttcttgattgttggccagtcctggagcttctccatctgcttaactgaagctgctctcctcagagaaaacctcccctccggctgactcccaaagtggaagtcagaaaattgtacatttggggaccctgatgggctcctccagagctggcagcaggcacagggacaggacagggggcactactagtcatgggtgttctcttcctgccttcctgagaggctgtgcctggactcctgatactgcctgggatgcctgaccctgtgcatctgagtctttcacctccatataagcccctccaatccctgagacctgcaaggtgcaagagagggagaatcacatccatccacagtggtataagacctcccatgcccaacgcagggctccactgctcctgtctgaaatggagtaggaaggcccctcagtcttcctcaaggtattagttcttaaggggcctccactccctccctcacctgtccagacagcaacatttgttccttcagccgctaaaatccattccaaatttttccactttactgctgagtgtgaagttaacatcatcgctcccatagcctatgttaaaggcttcattattgttgcttcttttcctatccttgtttctgaaaaaaccattgtcttttcagcagcccgtgatccttttgaaaaccaatacgtgattttcgttttaaatacacacatcagatttaactagaatgtgaagttatatgtattttggaaaatgcatggagtcccatatctaccaaccaagtatcatactgaccagttccatctgcctaaaattctcctgtgcatcccgtttgaagtcaatcactgcactccacaaagctcctggcaactctcttccgttttcagttcctgtagttttaactcttccaatttgtcatatgactaggttcataagatactgacttaacagtgcgcctgtactcttctttatcacaactagcaaggaatgagaatttctgttatcctatatcctctcttacatttagtattttagattttcaggttttagccattctcataagcatgtattggaatcttctttggttttcgtttgcatcttcctaatgacatatgaaatttgtcatctttttatatgctttttttcccattggtatagcctctttggtaaagtgtctattcaaatcatttgcatctttttgtagatgaataaacttcattttgagagcattgctaatccaaaaatacaaagagaaaacttcatcaaatttagagttcttgtatctacaccaccgccctgccctgcttgctgtacacacacacaaagtgtctctttttatttatattttgtgttattatgacatgtttgctgcaactgatggaactgtattacctcattattaagtccacggtttatgtcaggactcactcttaacgctgaggatactatagattttgataagggtgtaatggcaagtatgcatcattagagtattacacagaattgtttcagcatcttagatctcctgtgtgttccacctaatgatcaatcccccgtacaccaacaccaaccatcagctcctggaaagcagtcatatttttagtgtattcatcgttgcctgttccagaatatgatatgattgaaattgtacattatgtagcctttttagaatgttcttctttcacttagcaataggctttcacgattcctccaggtccatcccactaacaaccactgaaagttcctgttgctcaacatgcatgtcaacgtttgatgttgcagtgttttggatgtcagccgttctcctgggggtagagggctatctcctagttgttttaatttgcatatctataatgacataggacatttgacagtgttatgtgcttattttccattcctatatattctttgctggcgtatcttttcagattatctggcccattttatatttggttttcttttttctcatgattggatttccagagttttgtgactttctcacagttttggaatctggtagtccaagagcaaggtgtatacaaggttgtttcctgctgagggctgtgagggcaggatgttttccagtctctctccttgccttgtagacggctgtcttcactccatgtatgttcacgttgtcatcactctactcatagcactgtgtccaaattttccctttgtatgatgactcccatcatattggattagggccggcattaataaccacattttttaactattagtttaagttcatgatacatgtgcaggatgtgcaggcttttacgtatgcaaatgtgtgtcatgaaggtttgttgtacatattatttcatcacccaggtattaagccaatatcaattagttattttttcctgagcctctccctcttcccaccctctgccctctggtaggccttagtgtgcattgttcccctctacgtgtccttgtgttcacaacatttagctcccatttataagtgagaacatttgacattttgttttctgttcctctgttactttgccaaggataatgcctccagcttcatctattttcctgcaaaacacctgatctccttcctttttatggctgcatagtattccatggtgtatatataccacattttctttatccagtctatcattgatgggcatttaggttgattctgtgtctttgctattgtgaatagtgcctcattgaacatacacttgcatgtgtcttaataacagaaccatttatattcctttaaatgtatacccagtaattggtttgctggctggggtgaatgctatttcagtctctacatctttgagaatttgacagactattttccacaatggttgaactaattgacacttccgccaacagagtaaaaatattcctttttctccacaacctcaccacgatctcttattttttgacattttagtaatagccattctgtctggtgtgaggtggtgtctcactgtacttttgtttggcatttctctagtgattagtgatgttaagcttgttttcatatgcttgttggcagcatgtatgtcttcttttggaaagtgtgcatgtcctttgcccaccttttaatgggtttttttttttcatttaaatttgtttaaattctttatagatgctggatatagatcttcatcagatgcacagattgcaaaaaatttctcccattctgtaggctgtctgtttaatctgttgatagtttctcttgctctgcagaagttctttactttaaatacatcccgtttgtcaatgcttgcttttgttgcaactatttttagcatctttgtcatgaaactttctcccgtgcctatgtcctgaatggtattgcctagggtttttctaaggtttttatggttttgggttttacatttaagtctttaatccaccttgagttatttttgtatatggtgtaaggaagggatgtggtttcaattttctgcttaaggctagctggttcttccatcaccatttattaaatagggagttctttaccaattggttgtttttgtcacgtttgtcaaagatcagatggttttaggtgtgcagtcttatttctgggttctctattattttccattggtctatgtgtcagttcttgtaccagtaccatgctgtttggttactgtagccttgtagtacagtttgaagtgaggtagcatgatgcctccagctttattctttttgcttaggattgccttggctatttgggctcttttttggttacatacaaatttcaaaatagatttttgtttctagttgtgtgaagaatgtcagtgaaagtttagtgggaatagcactgaatctataaattgctttgggcagtatggccattttcacgatactgattcttcctatccattaggatggaatgtttttccatttgcttgtgtcatccctgatttgtttgagcagggatttgtctttctccttgtagagatacttcacttcccttgttagttgtattcctagctatattattccttttgtggcaattcggaatgaaagttcattcatgatttggctctcagcttgcctgttgttggtgtatacaaatgttcgtgatttctgtacgttgattttgtatcccgagactttgctgaagttgcttatcagcttaagaagcttttgacctgagacaatggggttttctagatatatgatcatgtcatctgcaaacaaaaatagtttgacttcctctcttcctatttgaatacactttatttatttctcttgcctgagtgtcctggctagaactcccaacactatgttgaataagagtggtgagagagggcatccctgtcttttgttaattttcaagaggaatacttccagcttttgtccattcagtataatattggctgtgagtttgtcatatacggttcttattattttgaggtatgttccctcaacacctaatttattgagagtatttaataagaaaaaatgttgaattttatcaaaagcttttctgcatcaattgagaaaatcatgtggtttttatctttatttctgtttatttgatgaatcacatttgttgatttgcatatgttgaaccaaccttgcatcccagaaatcaagcctacttgatcctggtggataagctttttgatgtgctgctggatatggtttgccagcattttgatgagcatttttgcatcactgtttgttaaggatattggcctgatgtttcttttctttttttttttttttttttgtctctgccaggttttggtatgaggatggtgttggcctcatagaacgagttagggagacgttcctccttttcaatttttttggaatgatttcagttggaatagtaccagctcttctttaataaccacatttttaacttacttgcctctgaggtaatcctgtctccaaataatgccacatgtaaatttcaacgtaagattttagcggggatgcaactgaacctataatagtggaaaaggaagtggcagacctatatgtatattattacccatgtgtagttataaacacacacgcattctcatatatgtatagattatattaaaaaaccacatctatctttctcaaaattctaaatcagcttttaaatttaaacactacagggttaattgtggagacttctgaatagggggatgagttttggaggaactttccaaaggggagaattgtgatttctacctattttttaaattttgtatcagaaatatatgcagtatttatttgtagggaaagtattgaaataagcctaagaaaagcatgaggagcagtccagtaggaagataaagtatcagtaagctcatggaacaccaagaagaaaaatccttgaaatttatgtgacttaacacgacaagtttattttttggcacgtaaattctgatttagttggcagggtgttatgggctgaattgtgactcaccccaaaaattcatatatccaagtcttaaaactcagtatcccagaatgtgactgtatttgaagacagaaactttgaagaggtaattaaggtaaaatgaggtcttaagtttaggttcatattcaatataacaggtatcctcataagaagtgcagattaagatacagacacacagaccaaggaacaaccatgtaagaattcagtgagaaagtggctgtctgcaagccacagagaggccagagaagaaatcaaaccagccaacatcttgatcttgaagttattattttgtaaattttctgtgaatctaaaactatcctaaagcaaaaactttatgtaaaaattgtaaatagaagcaggataattaggtaaggagactagaattcaaagtaattttttgatagggtggttagtttcctttactttttttccttctctgtcttctagcctggacttaaaggcatacaaaattgaagaattgcacatgatacagagacagaaagtgttctaaggcaattaatgttttcattttttctagaaaaacttttgtgtttgaagaactaggataggagattcctaaaagacaaagagaacatgagaaattcctttcttcttcaaggttggcctccaggcaagccaaccccattcctgaaggtgtaatcgtccaatgagagcactagcaccagctgctcaggcatctaaaactctgagtgaggaacatccttccctctgtcaagaagacctttgtttgaaaaagtacgggagaaaacttcgctgttatttttctctttatatgctctcactattttagccagggaggcagacccatacaaagcaggtggatggcataatggactgtactaaaagcccaatttctagtgagagtactagaaagagagtcagagaatatagaggagtgtggtagtcagtttgggttgccataacaaaaatgtcaaatattggggattaggttacaacctatgtgttttgatcggggacgtgcacaaacaaaaaagtcaatgtaagaatgagattgtatcaaatataattgacgtcttggatcaatccaaacttgtcatgcaggaatctttttactttttatttattttttattttatttatttatttatttatttaagatggagtctcgctctatcgcccaggttggagtgtaatggcgtgatctcggctcactacaacctccgcctcccgggttcaagcgattcttgtgcctcagcctcaggagtggctgcgattacaggtgcatgccaccacagctggctaatttttttttttttttgtatttttagtagagacggggtttcaccatactgaataggctggtcttgaactcctgacctctggtgatccgcctacctcagcctcccaaagtgctgggattacaggcatgagccaccgcgcctggccaggaatcttaacataaaaaggacaccatagctcggataactgaaataggagtaatttataaccatggtatcagattaacttctttcccttagcaacatgctttttatgttcatccctgtctttccatggctgataggccttttcttcttatggctgcatagtaatccattgtataggtgtatcacagtttgtttatactgttggtgggaatgcacgttgctaaaaccactatggagaacagcttggagactcttctaaaaatgaaaacaaaactcccatactatccagtaatcccactccttggtatttacccaaaatgaaggaaatcagtacactgaagtgatacctgcacaaccatgttcactgcagcacgattaacaatagccaatatgaggaagcaaccaaagtgtccatcagcagatgactggataaagaaattgtatttacatatacacattggagtactattcagccataaaagcaatgagaccctgtcatttgcatccacatggatggcactggaggtcattatgataagtgaaataagccgggcacagaaagacaaacttcacatgttctcgcttatatgtggaagctaaaaatcaaaacagtggaatttgtggacatagagtgtggaaggatggttacctgaggctgagaaatgtacaggatgtgggggagaagtgaggatggctgatgtttacaaaaaactgttagagagaatcaataagacctagtatttgagatcacaacagggtgaccatagtcaaaatgatttaattgtactttttgaaataactgaaagagtgtaattggattgtttgaaacacaaaggataaatgtctatgctgatggatcacccatttaccctgatgtgattattacacatagcaagcctataacaaaatacctcatgtaacccataaacatatgtaagtactatgtaaaggattatttactcagggagtagtgttgatatttaccaggataaatatcacctggcatttatccaccctgatgaccactctgatgacattccttttgttggtgacctgttctttctctctagctgcctttgatattttttctttcatcttgacattggagaatatgatgaccatgtgacttggggatggttgtcttgtacagtatctcacagggattctctggatttcctgaatttaaatgttgaccatccaacaagggtggagtaatttttgtgaatgataccttcaaatttgttttccaagttgcttgttctttctccctgtcttttagcgatgccaataggttgcaggattggtctcactacataatctcaaatttcttggaggtttgaggcattcttttatattcttttttctatataatttttttctgactgagttgattcagagaactagttttcaggctcagagatttttcctctgctgggttaattctgttgttcctacttttagttgtattatgagattccttcagtaagtttttcagccttatctgttctgcttggttccttcttaaaatggcgatttcatctttcagcttttctgtcattttattggattccttagattccttggatttggttttgactttctcctgaatctcaatgatctgtgtccctatccagattctaaactctccgtctctcattgtggccatttcaccctgctttagaaccattgctggagaactagtgtggtagtgaggaaggaagaagatgctctggtttttggagttgctagagttcttgtgctggttctttcttatctgtgtgggctgatgttcctttactatttgaagttactagaccttgaatgggttttttattcttttatactcgttgaagcccttgagtgtttgacggtggtgggttctgtcaagaggcttcatttctagaagatgttatgggcaaaagctcaggtcagtactcttgggctgtatgctcaacgtttggggactgatacgaggcccatgtcattgttctctgtcgctgtgatgtaaagcaactgctctgctagagacaccggggtgttccttgtccactgacaacgacactctgatgggagttgctgtctgaagtgcttcactggggcagaagcagcagagtctatgctcaaatgggcataccaccagcaagagcagaataccaccaccaacaagcataccacccagcttgtcaatagatgaaaatatataagtttcctaagtataaaatcaacatgggaaaaataaactttgttttcttgcagcaacaatgaatatgaaaataaagaaaatataacctctaacctatcattccaaacattaagtacctcaaaaaaactaaccaacaaaattaaaacattacagaaaaaccattaacacgttatttaaaaatattaatgaagaccgacaggaacagaaaataaattcatgggaatgaagtttcaatagttttccttaaaacggaatcgatagaataattgtaatcccaaatcaaaacaaccgaatgcctttgcacgtgaaggcatctatgaatcacctgattctaaaatgtaaagacatgcaaaccgccaagcatagtcaatacactcttgagaaagtgcaattcatccaacagatagtaagaattacaaaggagctattgtatgaagcgttggaggtctgggtgcatggattaacagatagaccaatggaactgaatggaaagtcctgaaaaacaaaaccaacaaaacatgtataaaagcaagcttaattgattaaaatgtgttgcagctttagaactggagactgtcttgttgaaataagtatcagtggaacaactaaatatccatataaaaaaccttaatgtaagtggaaccctttttcatattatacaaaaatgcaattacagggaaattcaaaacctacttttaaaatgttcattataataactttgaaaacacagaaatgcacagaataataagtctttgtatagattatgtaaggctggagttgaaagaactgaaagactctgaggtcaatggtcacttcagtagcaagaggagcgagatgatatgagtcaaagaggaacacaggaaatggcacctcctctctcccccttgtctcacccatagaaggtctagctgctttcataagcctgtgctttttgagagtagaacttagatctcaatagtagctgggggaaggctacctgggacaatgatggatttatccccctcttacttgaaccatcctcctgctgacctctggaactctggtgagtcaagaaatataaccagaacagttctattccagaaagtcctgatggagggctgttgtgttgatgacagacaccctgaccagatccacaaacactttactaacttagtggcagtgccaggttgctcacatgataggagtagaggcccatctccctctccacatggataagagatccacatacttcttttcagatgctcttactcctgacaggaccctcagaaggattcttgcgccctgagatttcaaaaaaggttgatttgtggctttgccagagattaccctgaggattggggttctctgcacccactatggtcaggatcaactcagctgttcatgagctgacttccttccttagctttgtcgccgtttcccaggggcagttggcctctgctcacagccaggattggtggatcatcaaacctcagcactcaaggtggaaacccacagacaaggaagctcttctcccagattgggaggcagctggtgggtaaactccagctctggcccacatgtccttgggaattatcctcatggagcttttcttctgaggtcccaagaagggagcatttcttatggatggtaaaaagaaaatggcagcctatccttttacctcctggtattggaaataagtgtcccttccagaagagagagggactaatgttcttggaattgaatcagtggggagtgtcaggggccttttaaacgagtaaacacaccccttctccaaacatgccccagatgactcaccttcagttcctatttctcacttagattcagccttcactgaacatgctgccactgacagtggaggtttaccataggtgccatgaatgtagaattgttgggcaccaggttgaaggaggggacggcattcccagatttcaaggaataagaaatgtttgtgcatgtgtcagagtgattacaaaatacacatgaaggctgtcaaaaaattgaaaaaccaaagtatgtcttcatttgatatttgttaccatcaaaggggcacaatttttacttttgtgcttgatttctcccttcatcttatcccaaatccaatccaacagcaactttttttccttccacctctaaaatccattccaaatccttccactttttcaatctccattactactgctgtatgtgatgttaacattctctctcagctagactaggttaaagtcttctttattgttgctacttaaaaaaaatcccaatccatggcatggatggagctagaggccattattctaagtgaactaacacagtaacagaaaaccaaatactatgtgttctcacttataagtgggagctagagaggagaacacatggacacatagaagggagcaacacacattggggccttgcagagggtggagagtgggaggagggagaggatcaggaaaaataacaaatgggtactaggcttaatagatgggtggtaaaataatctgtacaagaaacccccatgacacaatttacctatgtaacacacctgcacttctatctctgaaagtaaaagttaaaatgttttttcaaaaacacacatcaaatgtaactattttgtgaagttatacgtattttggcgaatgcatggcatcccatatgtaccacccgagtatcgtaatgaccagtatgatcaacttaaaattctcctgtgcatcccatttgaggtcagtcactgcacttctgcaaagcccctggcaactatgttcttctttcagttcctatacttttagctttcaccatgtcataagaggaggtgcataaaatactgatttaaaagtgcagctgtatcagttttcatcacaactagcaaggaatgagaattcctgttgttccatatcctctcttacattgggtattttagactgttggattttagccattgtaataagtgtgtattgcaaacttctttggtttttgtttgcatctccctaatgacaaatgacattacatgcctctttccaatatgtatattctctttggtaaagtgtttgttcaaattatttacattttttttaaaaaaataggcttcatttttagagcattgctaatccaaaaatacagagagaaaacttcgtcaaaattagagttcccacagatctacaccaccctccctgctctgcctcacacgcacacacacccacacacacacacatgaacacacacacacacagtgtctcctattatttacaatttgtattattatagcatgtttgctacaactgatggatctgtattgatacctatttagtaagtaaattccacagtttacatcaggactcattccacattgtggatgctatggtttttgatgagtgtgcaatggcaagtattcatcattacagtatcatacagaattgtttcaccaacctaaatctcctgtgtactccacctattgattaatcctccattcctcaactccaacccctcagccctcggaaaccactagtatttttagtgtattcatcttgcctgttccagaatatcgtatgaccggaatcatatattatgtcgcctttttatattttcttctttcacttagcaataggctttcacaattccttcaggtctgtcccactaacaatgattgaaagttcctgttgctcaacacacgtgtgaacacttgttggttcagtgttttgggtttcagccactcttctgggtctgtagtgttatatcttagttgtttcaatttgcgattctttaatgatatatgtcattgtattattctgtttccacatggctataaagaaatgcctgagactgaataatttataaaagaaagaggtttagttgactcccagttccacacggctgcgggaggcttcaggaaacttatgatcatggtggaatgcgaaggggaagcaggtacctttttctcaaggtggcaggaggaagaagcacgaaggaggaacttcgaaacacatacaaaacaatcagatctcgtgagaactcactcactacaaggggaacagcatgggtgaaactgcccccatgatccaatcatgtccctccctggacatgtggggatgaaaatttgagttcagatttcggtggggacacagagccaaaccatatcagaaattggacagttgtatccgattactttctattcacatatatctttggtggggtacctgtttagaatttttggccattttcaattaggttttctgttttcttatgattgggttttagcattttgtgcatatttaaatatatatcttttatcagttatgtgtttcagaaaacatttatcccagtctctgtctttcttttctcttagcagtcttttagagtagaagttgttaattttaatgaagtccaatttatatctcttttcttagatgttggcacttttggtgttgcatctgaaaaagtcaccaccaaacttaaggtcaactagggtttgcacctataagtttgaccaaaattttggtgatgcatctgaaaatgtcattaccaaaaccaaactcccctaggactttcacccataagtttcagtaaggtttaaaattctgataaaatatgtttgtcaacaaatgaatcatttccacatcaacaaatgtgtagggaaactaattggtgagacctttggtggaaagagtcagcaacatttgaaaaagtataaaattattcataccctgttcacttctacacaacttctacattgaaatgtattccttataaggaattttatgcatttgtcccagaatttatgctcaaatatattgattatatttatactaattttagccacaaagaaaaagcaaatatgtgttcatcaggaggaggttggttcagtttgttaatgcacagaaataaattggcattctcgggaaaagtccccaaagtaaggcagatctctatgtgctgacatggaaagatgctggatacattttaataagtgagtatcatggcatgttagggttgcaatagcaaagtaccacaacctggatgacaaaacaacagaatttcattgtctcacagttttggaatctggtagcccaagagcaaggtgtacacaagattgattccttatgaggctgtgattgggggatgctttccaggcctctctcattgccttgtacctagctgtcttccctccatgtctactcacattgtcatctccatactcatatctctatgtccaaatatcccctttttatactggcttccaatacggccagcattaataacctcattttaacttgattgcctttgaaataatcctatctcgaaatcaatgccacattttaatttcagtgtagaattttgtggaagaggcaattgaatctattatagtggcagaggtaagtggcagatctatatgtatatcattatatcattacacatgtgtgtatatatgtacatatatgtgtatatataaaatagcacatctatctttatgaaagcctgaaatcgaaaatcatattttaaaatttacacggccacattgttacttgtggaaatttctgagtaggaggctgagttttggaggaactttgtaaagaaagcaatgcaatttctatgtctttttagaatttttttgcaacaaaaatacatgcactatttacttttaagtcaaatactgaaatgaccctaagaaaaggaagaggagcactccagtagtcacattaacagtaacctgatggaaaagaaaaaactccctgaaagttaaatggcttcacacgagttgatttttgtgcacataaattctgatttaagttggcagggtgttatgggctgaattgcgcccctttccgagttcatatatccaagcctcaacccccagtactgcagaatatcactgtatttggagacagaacctttgaagaggcagctaaggtaaaatgagatc

SEQ ID NO: 515 - DNA, 4369 bp, Homo sapiens
ttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggtaaaaaaaaaaaaaaaaaa

SEQ ID NO: 516 - DNA, 464 bp, Homo sapiens
ttttttttttttcacacggagtctctctctgtcactcaggctggagtgcagtggcacgatctcggctcactgcaacctccgcctctgggctcaagcaattctcctgccttagcctcccgagcagctaggattacagatgcccaccaccacgcatggctaatttttgtatttttagtagagatggggtttcaccatgttggccaggctggtctcgaactcctgacctcctgatctgcccacctcggcctcccaaagtgctggaactacaggcttgagcccctgcgcccagcccagccctggtaaatttttaaaattgccacatgtaatccagaagtgtgattaactaaagtcctttcctcagctataatgttgattgtgtgacttgataacttatccgtggtggctcttggacccctgtgtgtctttggagctccaggagcacacggacccctgggcaggtccct

SEQ ID NO: 517 - DNA, 1904 bp, Homo sapiens
cccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgaccaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacatgtcactagtttccaaaaaaaaaaaaaaaaaaaa

SEQ ID NO: 518 - DNA, 539 bp, Homo sapiens
ttttttattaacatgatcaattttattaacaacttggatctcttctaagcagactctgtccgtatgcctttccaaaccatagctgccttaactgactgccttggtgtttattctagcgtaacattgtccagtagaactatctgcagtgatgatatgttctgtgtctgcactgtgtagtagtagacacgggtggctgctgagcacttgaaatgtgattagcgcaactgagaaactgagcttttaattttatttcattttaatgtaattagctacacgtggctagtagctgttgcagcggacaccacaggtctaaggaaacaacacagaacattcagctaggggtgtaccctcatagcctgtgagtgtctcttactcactgtcatgggggaaggtgagttacacagggaggtaccttcttgccgcctcttttaggatttcctaagtatctctccttcatcctacctgccatcattctttgactttatgtccattttctaaacctttgcctacacttgctcttatctacatggagttgttca

SEQ ID NO: 519 - DNA, 987 bp, Homo sapiens
catccttggagagagctgagagctcgagggacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttaggtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactccaagaagagcccaagaagacattactactaactgtcacatggtgtcacggatgggatcttcggacagaaaaaggaaattgggccaggcgcggtggctcacgcctataatcccatcactttg

SEQ ID NO: 520 - DNA, 558 bp, Homo sapiens
  misc_feature (55)..(55): n is a, c, g, or t
  misc_feature (152)..(152): n is a, c, g, or t
  misc_feature (241)..(241): n is a, c, g, or t
  misc_feature (272)..(272): n is a, c, g, or t
  misc_feature (314)..(314): n is a, c, g, or t
  misc_feature (391)..(391): n is a, c, g, or t
caccttaggcagctttttattttgcatcctttttttcaactttgtcttctattanctgtgcaagaaatacatgtctgctaaagttacacgatcttcgcacaacagcaacctacacattagtctacaaaggggaacaaacccaaattcctcanaagtctgagtccactgttgccttctttctggccatctggcagttacaatatagcacagaatgactatgcaagttaaatattcatcttanacatggacatttgctttgggactcctaaagnggagtcaaatttgatctctacagaaactctacaatgtagcanagcactgtgcgtacttattgactcccagacaagccgaaaccccgaatttgtcatttctatcagtttttatataaatngttcttacctacttattgatgcttacaatttggcaattataaggggcaaaattggagcaagtgttttgggtaaataactccttacaatatattaaaaatacttcaacaattcttagaatcaaacacttacgtaaatccttttttaaaaaaataggccaaaagactca

SEQ ID NO: 521 - DNA, 578 bp, Homo sapiens
ttttttttttttttttgctaataagtttggtttatcatcacatcaagataaattgcctttagcatagaacttgagataagtagacgttcactagcaagtgctaacatttggatcagggcaaaggcgtttccaggagtgtttttataccagacccctgcttagtccatggggctgaggcatgtcacataactcagagcaagagccttctatttgtgtaagacccaaccctgggaaggatgcccgagacaatagctatgcctctgccccagcctgatgccatgtgatctagagcctgggcagcaacaaccctgtggtcaaagacatggaagaaacactctgcaaatcccacagtctgttcgacggcttggaaaggaagcaagtggcattgggacaattgctctacatgcctacagcttacctgtcaactacagggggctgccaaggtgtgcaagacgacctgggggcagagccatgctcagggcacagatagatggggatgggagtcgagatggggcatgggaagtgatgagggctctgagaacacatgaagcaggtattggacatcagcagatagatga

SEQ ID NO: 522 - DNA, 4447 bp, Homo sapiens
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaa

SEQ ID NO: 523 - DNA, 567 bp, Homo sapiens
tggattagggactccaaaggcagctgacagcatctggctttcagttcctcagtcaccactactttgtaccaaattcactgttttggctctgaaatctaattttgagtttagcaaggatgtctgcattgctcatgcaaatgaactaagcgttcattggaatgacaccatcaccacccaaatgaaaagaactggctggaatattcatcagcctactaatgtcatctcccaacccactctccaaactccatcccaaaaaagcatccatttcagaattgcccactgttggcaaagaaagaatgtcactaatttatttacagggagcaaatagcagggacttacagatgaaccaggccctgcgatttttggaaaatgagcaccaggaactgcaggccaagattgaatgcctgcaaggggacagagacctgtgcatcttggatacccaggacctacaagatcaactaaaaaggtcagaggctgagaaacctaccctggtgaccaaataacagaattggcaggttttgcttcaaaatcaatccttaccgcttcaagaacgagagaaactcttac

SEQ ID NO: 524 - DNA, 468 bp, Homo sapiens
tgaggcatacacatctctttatttacaaaatgcggtgaagagaaaatatctagatatttgggtgtaattattccaaacatagaaaacacacaatagaatcaagtgaagggaaagctactgtaacagcttagatactttttaaggagaactgatagtaaatctgggaatgggaaaaaaacacagagctagaatttgtttagcactccgtgcaaaaggcaaaagctgataaaactggagtggacggaggctccgaatgtggccctccgctgctctctctcctgcagtctcatccccggccttagccctgacctctcctccgaagcccctggtgaaggccgcgatggcaaccacctgcaggacggcctccaggccgtgaagggccaggagcgtggcgctgagggcccagtccgcccacaacactagggcctgccaaagcaggaagtgggcagagaggagggcggtgccagc

SEQ ID NO: 525 - DNA, 2047 bp, Homo sapiens
tttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaatggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttacctgtgtgaaattaaagtttaagagacctaaaaaaatgtactcccataaagaatcaatactgcttcaaaaaaaaaaaaaaaaa

SEQ ID NO: 526 - DNA, 607 bp, Homo sapiens
ttttttcttaggtggagtgaagctgacagtacagtagatttggagagtaatacaaatcctttctttctggttagaacacactgccaaaagccatctctttcatctaaggaaaagattaaaaatgcatgttgatatctcctaactatcacacaacttccactattacaatgaaaaatctgttcccctttcattgcctctgaaaactctttgacgagtagatttcaaaaacagagattttaaaaatttgcttgctttactggtgaaggacatttgcattttttttttttatttatttaaaggaattagtttgttctcctggctcattcctctttgttactttctgttccaatacacagaaagcttgatcatctttgatcagcagaaatatcttttatttagcaaagctcaacttcccaagagttatgcatggtgtgcctatctgaaggtggtgttagctctgttgaaatgcctgggtctgagtaactgtcatgatttttatgattaaaaacagactcttcatcaagaataatgactaattctaattggtctttgtgatatgtaagataactcataaatgaattgcaatggattttatttcgaattaact

SEQ ID NO: 527 - DNA, 13147 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 528 - DNA, 1612 bp, Homo sapiens
agagcggagcggtgggccgggggctggaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagca

SEQ ID NO: 529 - DNA, 3953 bp, Homo sapiens
ggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtcgaaaaaaaaaaaaaaa

SEQ ID NO: 530 - DNA, 1665 bp, Homo sapiens
gttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaaaaaaaaaaaaaaaaaa

SEQ ID NO: 531 - DNA, 719 bp, Homo sapiens
ctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttgagagctttccattacatgagctgtctcaaagccctccaataaattctcagtgtaagcttcaaaaa

SEQ ID NO: 532 - DNA, 10932 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattagttttaaaagtggcctatgtgactgcttttctaaaaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttc

SEQ ID NO: 533 - DNA, 564 bp, Homo sapiens
  misc_feature (406)..(406): n is a, c, g, or t
  misc_feature (445)..(445): n is a, c, g, or t
  misc_feature (484)..(484): n is a, c, g, or t
  misc_feature (520)..(520): n is a, c, g, or t
  misc_feature (526)..(526): n is a, c, g, or t
  misc_feature (533)..(533): n is a, c, g, or t
  misc_feature (547)..(547): n is a, c, g, or t
  misc_feature (562)..(562): n is a, c, g, or t
ttcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttgggtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggtnttcattcacgtattaattgcacatcagtatgtgccaaanctactagacattggagaaccagtaggaccacacatggtncggcacatgatcttcaggaaacgagtaggtataccngaaaanccgagtntgatgctagagacntaccggatctgagantt

SEQ ID NO: 534 - DNA, 6850 bp, Homo sapiens
gaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaa

SEQ ID NO: 535 - DNA, 1507 bp, Homo sapiens
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaaa

SEQ ID NO: 536 - DNA, 5621 bp, Homo sapiens
ccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcagtgcgcgatgatttctttggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgagaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatggcagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggtgcttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggaactggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtc

SEQ ID NO: 537 - DNA, 2193 bp, Homo sapiens
ggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattcagctgttaaataacattttctaatttgtataaatggtactatggtactaataaaaacctaaattctccaaccaatttttttaaactgccaggaacaccca

SEQ ID NO: 538 - DNA, 2084 bp, Homo sapiens
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgc

SEQ ID NO: 539 - DNA, 1320 bp, Homo sapiens
cggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 540 - DNA, 2377 bp, Homo sapiens
acccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 541 - DNA, 3213 bp, Homo sapiens
gaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaaaaaaaaaaaaaaaa

SEQ ID NO: 542 - DNA, 2816 bp, Homo sapiens
cacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtcaaaaaaaaaaaaaaaaaa

SEQ ID NO: 543 - DNA, 2917 bp, Homo sapiens
gttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcaaaaaaaaaaaa

SEQ ID NO: 544 - DNA, 2047 bp, Homo sapiens
ccgccttcgcccacgtggtccggctccggctcagtcagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaa

SEQ ID NO: 545 - DNA, 11347 bp, Homo sapiens
gcggggagccggcggttatctgggcggcggagcgctcacaatgtggcaggagacagaaaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtcagataggctcattcggagttagatttttaaatttgaatgaagaaaagacaacaatttaaaggcatgtggcttcatttccacatatatttgtgactggattcttatttttagcaagaggggagatcgccacaaaaaaaactttagttcaaagaagactgtgcaaatcagttacctgtactttcatagtctaccatttacattaactgttctagattaatgactaagcatggccattaccataattacatcatttttttaaaaccacatttgttcgaagtatccttttctagtggttagaactgtccctataatttgattgtccctcatatactaaccgaaagcaaaatgctctgatgagatgcttataaactatgaattttttaattcttgaaatttttttcagtttttatgattgttgaatagatatgtatgtttagttccattattatttcactggaagttttaaattttgagaagatgaagcagagatagaaatccattgcagatatatgtatatttaccccatcttgcaggtttcagttagtaaaacacagaatgataggtcggttttaatgttttaaaaaaaaactaaaaaactaaagttagagaaacctttctgtttgagctactgtatagaaaagacaacttttattgcattgctggtccacatgataaatatttcaatgctgttctagactgtatgagaagtacttaatgaaaaaagggatacattacatttaagaattgtatcagctaattactgttttaaaaaaatcaactcatttggaattcttcggactataaaattgagcaagtaaagtttgggttttaattttcctttgcctgaaccaagataggaaattacttaagagttttttttttttttttttttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaaaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaaaaaaagcagccata

SEQ ID NO: 546 - DNA, 116510 bp, Homo sapiens
gatcacaccgctgcactccagcctgggaaacagagtgagatcgtgtcaaaaaaaaatttttttttaatttttacaatttattcagaggactattgcacctgtacagaagaacttaaagtgaattttgctgtctttttcatgaggacattagtctttgccacaatgcttactactaatgagtacaagaaaacgctgtgtgggacagagttgctcgatccaacctcacagattgacaggcaaacaaatgttttatagggcaaggtagctgttggaattaaactttttaggatttttgataacagaatatgtacttctcataattagggttttttaaacatttttaaggatttttaaacttttataaaatctcagaattttctagtctgtgaacagttcatgtagaaaaatcagtggttattatgtacactgttattgcagcttcgctgaaagattaaaaatctaaaaaatacagtaaaaataagttctgagtttttgtattgatgttgggtgctgtgatgttatctcttttaaaatgtgtttttctttttccataatataaaggaatcaaaaaatacaacttgtatgtgaacttgtgcaaatgtgtgaaacaaattaaggtgacagggcagaagcaacaaaatgaagctcaaatgaaatccacctctcaaagcaggttctatttaatttctctatatttgctattataaattttttattttcatatatgtgtttctttgctagagatgataattggatgccaacctaacttccaatttttaggtgattattttaccaacaaaccactcaccttgatgagtgcactgcatggcccccgctccaaagtccaccattcagatcctcatcaatatgttatgacgactgttgcctttactgtgtctctgcctgattccataccctttgctctacatttcatctcaggttctgtcttttggaccttttcacttgatgcttgttcctggcatttgaatctccattcaacctgatgatctttgatttagactcaccatccagttccaagctgccaggatttattaccctctgatttcagcagctcagaaatccctggcacagtcacaggctggctacctcaagggaccagccccaaacactagtgctgtattataaacatccatttattcatctttttaacagattttacttattgcccactatgtataaggcactacagaagtttctggggatatagaagattagtggcagaaagctcttaagtctcttaaaatctggtaggacaaataatacaactacataattataatttaagatagtatgtgttcaactactagaagttatatatacgaacaggacagtaattaacaaaagcttcaaatagatccttaagtaattaaggagcatagggtacgaggatacgttaccaataacctagagtggtaggtcactgacaggtggcatcttaactagattttgacggtaagataggggagacatcatggaagacagatactacaaaaactggaaccaacaagaacaggaaaaatgttatgttaaaccttatttatccagactgacagtgtaatgaggagtggaagaaagcttagaaaaattggttagaaccaagttctggaaggctttgaatggtgaagagtttagagttggcgagcatgtattggacagtcagaaggttttgagcaggaaatgaaatgataattggcttgatttagcagtggtatgtaggaaggatttggtggtgaggtgatatgcaggcagagactgtaagctagtaatttaaagtaggggagggtctggagatgactttcttcatgtcattaaatcttgttatttgtgaggtgctgagctaggtgctggggaaagagtgagaactagatccttgccatgagggagttttcagtctagtgagagacttgatatcttaaagcctccttgaggggtctctatccaaaatttggtactctgcttctgactcttgcctgattactaggtgattagatcctcagtttacaatgggctgtgtttcctaccctctcaaactgcttttccattttttgtgtcagctaaggcaaaaatattgcaaccacttgtatatggagaaaagcaatttattacttaaaacaagataagacatgaatactgcaccagataaggcaaagaagaaaatgacatgtgtcttaaagagataactgaagatgatgtggagaatgaattggaggttatgttaggggcaagaaaactagttaagaggctgtcgtagtaatctacctgcttaattaagagggcctgaactaagacaatgtgaaagaaaaggagtccttggtggctacttccaccataatcctttctgtctctcccttggtacaacgaagggatagataggtgactctcatttggaattgacttttgaactgagggattcaaaaacaacaaacactcagtttacttcagacttaggggtaatgctcctactgtcaagtagtctagtttctggttatctttttatttggaacatggttctgcagtctttagtgagcttcctgataaatctttcttttgcattagttagactgttagttactagtggttacagtattaaaaacaacacaaaacaaaacaaaaactaccctaattgacattgtatgtgatatttgaagcacttatggataactaggagaaaactgttagggagttggaaatatggaactagaagtgtggttctcaaggtgtggtcactgatgcagcatcagcatcacctgggaacttactaaaaatgaaaattaacaggtcccatcccagacttactgaataggaaactgggagtgaggccccagcaatctgaatattaacaagccgtccaagtgattctgatgcacactgcagtttgaggaccaactgaactagagcttgaaatagagattaggagtagaaataaagatgtgtaagtcagatacataacagtcactcttgagagaatgaataaactccctagaagagtggaagagagaagatgagcccttgaagtaaatggaacaatcaaagaaataaaaactagtggagtacaataaaagcgggagaaatttaacagtggtatgaaatgacctatagtgtcaggtgctgtacagaggccagcatggatgaggatcatgccaaagctgtaagactgaccattaggagaattttggtgtcagttaaaagagaagtggtacagataagagtaaatgcaaaggaatacaagcaaaaactaaaggatactttttgcagcagtttgggaatacaacaaagggacttagaataatatggtcaggatgaggtttttcagggtagatgcatcatttaggttttgctgtataacaaacactctaaagtggcttaagacaataattattattatagctcacatgtctgagggttggctcctcccagctgggcttgctcatacatcagcagacctactgggagctttgctctaggctggacacttacctatcatcctccttctgtgactgtccagctcacttaggcatatctttctcatgaagatggaagaagtgttgaagagggcaaacagaggctgggcgcggtggctcacacctataatcccagcactttaggaggccgaggcgggcggatcacctgaggtcaggagttcgagaccagcctggccaaaatggtaaaaccccgtctctactaaaaatacaaaacgtagccgggtgtggtggcacatgcctgtagtcccagctgctcgggaggctgaggcaggagaatcacctgaacctgtttgcgccactgcactccagcctgggcgacagagtgagactctcccaaaaaaagaaaaaaaaattgggggtggcggcaaacacaaacacatggactccaaactgacactagcacttctccctcattctagtgaccaaagcaatttatgtggccaagcccgtattcaaggagcagagaaacagaattctcctctttagagaacttgcaaagtgacatggcaaagggcatggattcatagagggatgaagaattgggacgcttaataccacagtaggaggccaggagtggtgactcttgcttataatcccaacactttgagaggccgagatgggagggcccaggagtttgagaccagtctgggcaacatagggagaccctgtctctccaaaaaaaatttaaaattagccaggtgtgatggcacgtgcttgtagtcccacctactgggaaggctgaggcgggaggattgtttgagcccaggaatttgaggcttcagtgagctatgattgcaccattgcactctagcatgggaggcagcaaagcaagaccctgtctcaaaacaacacacagtagagatgacccgaacatgcttgaaagtacaaagaaggaatatgtagaatgaggaagaaagagaagtaaggagaaagacaaataaaagttcagagaattaacctttgaaaacagaaaagatacttctgggaatggaaagaagggaatttgattggattaaatttaacaaattaaaatccaagatgcccagttaaaattgaattttagatgaacaattttttttagtatttaagtatgtctcatgcaatatttggctcggtacatttggtattttttgttatcttaaatactatttacgtgtttctatatttgggacataactttaaactaaaatttttctttattattgtaaattcaaatttaactaggcatcctgtattttatatggcaaccctacttcggatgaattttaaataaatccatggtaaagtaatctataaagggatagatgggtatattcagggatttagtcctagaaaaagttcggaaccgctgctatagatgctgtgtagtgtcagtgaaaggattgctgagcagtagtgaactcacttaaaaagaagcagcatgacttttcttgattgaatcactgctaagaagagtaatagcagagattgctggtacaagggaccactttggtttggctctagctggtgaggactgagcaggagatttgggcataattgaaatgactagagtccaggctgtaaatgaaagcaggtgaaaccagaagatgaattagaagggactgagagtttggcagtcacaatgagtcaaagaggtagaagttcacagggaagaaactcagaatttacaatcttggaggaatggttctgtatgataacggggttaaaaatccaatttcacatttacttttactaaattaaaagtaagagctctggagacaagatacttggttttgaattctggttgtgtgatcttggccaagtaatttaacttccctgtgtcttcgctctttatttgaaaaatagtaataatgatggttcttggggccgggcacagtggctcatgtctgtaatcccagcactttgggaggctgaggcaggtggatcacttgaggtcaggaggtcgagactagcctggcgaacatggtgaaaccccgtctccactaaaaatacaaaatttagccaggcatggtggcatgcgcctgtaatcccaggtagttgggaggctgaggcaggagaatcgcttgaacctgggaggcagaggttgcagtgagccaagatcacgccattgcactcgagcccgggcgactgagcgagactgtgtctcaaaaaaaaaaaaaaaaaaattggttcttacctcataaggttattgtgaagattaaatgaaataaaccatgtgaaataccaagaacactatgtctggttaagtgtatctataatcactatatatgtgtgccctagagaatattattttaaagaaaaaatggcaacaatacattgtatattttcctccttggtaagctaacaaatgctatgtttggtaaaaacaaacacaattatctacctgttgaagctcacacaacttttactatttaaggttgttttctttaactgttattagaagaaaataattatgctcaagtcatatctgtctcatttccctgtaggtgaccatgctttgggattttcatagtttgagtaattcctatgggctctaccacccagcgagttaaagaagacaagattccacccccagggggttgtggttctgggaatgtgagcagcttgttttcaggagatctgcatcttgatctggcctgctattaggatctgtggtggtggtgcctgtctggttttagttgtttcttttatcttacacagatttttgtaagttatttgcatataaaggtttttgaaaagtgaatgttttatgggggcatcttgcttatacaaagaaaaattaaaactgttttaaaataatcactcgtgttacacttgtctattctaaaataaatgaaagtattaatgttgttgtctggaaggaaaatgaagaccaggaaaatagctatgctcttaatgttttaaaataaggtaatattattctctgtttgaatggaggcttctaaggaattaccacagtctcacacacaatcgacttaaatgcattctttatctttaaaaggaagcagaataggatcattgagtaaatcacatgtgttcacagtcttgtctggtgtaatcgtatactacacaaacacattattctgtagtcaggaggggaaggggacatttgaagcaggacttgcccttgaggaggcctttttctgtttaaagtatagtgcagtgaaagaccacacagtagaagataacaaaatatcttccatgccacccccactttttcattttctcattctcctttgttctctaaggacatctgttgaaatgattattctgtaaaactcataggtacctagcagaagccatatcatatttcatttattattttgtctacttaattattgttttcttttatatcatgcaattgtgggttttaaaaatattctgtttataaaagatatgaaagtatgttatagaaaatttattagttaactgtagatatctaaagagtaaaagtttcaactctgaatttaataaaattatatcttaggaagcccagcagacttttattaagctacgtcttaaaaagataaatatactaaaaagagatacttaaaaagatgaattttcctttctatattaattacaatggatttttagataatatggaaatatataaaagtagtcagtgtttagacatttgaaaaattaatgggaatatatattttgctgtatggttctgaaagtactaattggtaattgaatcataaaatatcagagttgagattaaagagctaaaattaaataatatcttcagagacttaacagagatctttcatttgtgccaaatttagtaagatttgcctcaattcagttttacttatggtgtatattgattctttaaaatgtcacgtgtatggtggctcatgcctgtaatcccagcactttgggaggccaaggcgggcagatcatgaggtcaggagatatagaccatcctgcctaacatggtgaaaccctgtctctactaaaaatacaaaaaaaggcccggcacagtggctcatgcctgtaatcccagcactttgggaggccgaggtgggtggatcacctgaggtcaggagtttgagaccagcctggccaacatggcgaaaccccatctctactaaaaatacaaaaattagccagacatggtggcaagcacctataatcccagctacttgggaggctgaggcgggagaatcacttgaacctggaaggtggtggttgcagtgagccaagattgtgccactgcactccagcctgggcgacagagcgagactccatctcaaaaaaaaaaaaaaaaagtcacatgtaaccatttgaaaggcattcttaattgtgaacaatagttatgtgagattttggaagatccaatatagatgcattatttcaaatgttttcaacattttgatagttggtttgctgtctatattgtggatgcaattcaaaattcaagatttttctttttattagaggttctttatttacattgccacccaatttcagcctaagttgatcttttgtggattcatggaatttatgtttgaagagttttaaaaaatttttttaatgaaaaactgttaacatatacagaaataaagcaaataacatgaacctccaagttttgtttgagtctttagtaatatgttagtacaggtactgtgattgttgatgcaacagatgttcaggaactcaaaaaatgcttgttgcttaatgtgcacttgaaataatttgtcagagactaggattgcaacccttgctttttttagctttccattttcttggtagatcttcctccatccctttattttgagcctatgtgtgtctctgcatgtgagatgggtctcctgaatacagcacactgatgggtcttgactctttattcaatttgctagtctgtgtcttttaattggggcatttagcccatttacatttaaggttaatattgttatgtttgaattggatcctgtcattatgatgttagctggttattttgcccattaattgatgcagtttcttcatagcattgatggtctttacaatttggcatgtttttgcagtggctggtaccggtgttcctttctatgtttagtgcttccttcaggagctcttgtaaggcaagcctggtggtgacaaaatctctcagcatttgcttgtctgtaaaggattttatctgtccttcacttatgaagcttagtttggctggatatgaaattctgggttgaaaattcttttctttaagaatgtgtgaatatcggcccccactctcttctggattgtagggtttctgctgagagatccactgttagtctgatgggcttccgtttgtgggtaacccaacctttctctctggctgcccttaacattttttccttcacttcaaccttggtgaatctgacaattatgtgtcttggggtcgctgttctcgaggagtatctttgtggtattttctgtatttcctgaatttgactgttggcctgccttggtaggttggggaagttctcctggataatatcctgaagagtgttttccaacttgcttccattctccccgtcactttcaggtacaccaatcagacatagatttggtcttttcatgtaagtcccatattttcttggaggctttgttcgtttcattttactctttttttctctaaacttgtcttcttgctttatttcaaattaatttgatcttcaatcactgataccctttcttccacttgatcgaatcggctattgaagcttgtgcatgcatcacgaagttctcgtgccatgcttttcagcttcatcagatcatttaaggtcttctctacactgtttattctagttagccattcgtttaaccttttttcaaggtttttagcttccttgcgatgggttagaccatgctcccttagctcagagaagtttgttactaccgaccttctgaagcctatttctgtcaactcatcaaagtcattctccatccagctttgttccattgctggcgaggagctgtgatcttttggaggagaagagacgctccggtttttagaattttcagcttttctgctctggtttctccccatctttgtggttttatctacctttggtctttgatgttggtaacctacagatggggttttggtgtagatgtcctttttgttgatgttgatgctattcctttctgtttgttagttttccttctaacaggtccgtcagctgcaggactgttggagtttgctggaggtccactccagaccctgtttgcctgggtatcaccagcggagcctgcagaacagcaaatattgctgcctgatccttcttctggaagcttcatcccagaggggcacccacctgtatgaggtgtctgttggcccctactgcagatgtctcccagttaggctacatgggggtcagggacccacttgaggaggcagcctgtccgttctcagagttcaaacaccatgctgggagaaccactgctctcttcagagctgtcagacagggacatttaagtctgcagaagtttctgctgccttctgtttagctatgccctgcccacaaaggtgaagtctatagaggcagtagacagtgctgagctgcactgggctctgcccagttggagcttcctggccgctttgtttacctactcaagcctcagtaatggtggacgcccctcccccagccaggctgcagcctcgcaggttgatctcagactgctgcgctagcagtgagcaaggctctgtgggcatgggacccactgagccaggcacaggagaaaatctcctggtctgctggttgctaagaccgtgggaaaagtgcagtattagggcagaagtgtcccatttttccaggtacagtctgtcactgcttcccttggctaggaaagggaaatcccccaaccccttgcgcttcccaggtgaggtgatgccccgccttgctttggcttgccctccgtgggctgcacccactgtccaaccagtcccaatgagatgaaccaggtacctcagttggaaatgcggaaatcacctgtcttctgcgtcagtcatgctgggagctgcagatcggagctgttcctatttggccatcttggaacagaaaccccacttgaaagaatttgtgtacatgaaaatttttaaaaatccctccatttcctaatctatgatagaatatatttcaaaaatttggtggtaagccaatttttggacctacaaatgtgtttttcatagaaacaatcttaaaatggctactaggttttcaggccagctctccataacttatctaattcatagtttagggaaacttacccatcatttttaacattgtttcaatgagaaaatgcctcttttaaaaaaatttttttctggctgggcacggtggctaacgcctgtaatcccagcactttgggaggccaaggtgggcagatcacctgaggttgggagattgagaccagcctgaccaacatgcagaaaccccatctctactaaaaatataaaattagccaggcgtggtggcgcatgtctgtaatcccagctatttgggaggctgaggcaggagaatctcttgagcccgggaggcggatgttgctgtgagccgagatcacgccactgcactctagcctgggcaacaagagtgaaactacgtctcaaaaaaaaatttttttttcttttcttttttttttttaaattagactctcattctgtcgcccaggctggagtgcagtggcacaatcataactcactacagcctctaactcctaggctcaagtgatcctcttgcctcagcctcctgagtagctagggctacaggtgcacaccacaatgcctggctaattttttaaaattttttttctttaattctttttttagaggaggggtcttgctttgttacccaggttggtctcaaactcctggcctcaagtttgcttttagcctcccaaagtgctgggattataggtgtgagccaccacactcggccagaaaaatgcctcttttgcaattagaattctagggaataccaccactcatcttcctctctgttgaaaatgggtagtcgagttatcttgtaatagggattttgtctgtgatgggtccttagctctctcagcaaaagtagcaggaactcagagtaaacagtcgggggacatagtatacttcatgtatactcttccgaaattattcctctgctagggggagttgaggagtcaagctctcctgtaataggtatcttgtctgtgagggctccttagctctcagcaaatgtaatgggaacactgagtgttgggggacaagagtctactctcccataccattctgaaattatttaccactttctctgctgacagagtttgtttgtgcttttttttttaagcttattttttaaaagaacagaaaggaaacctccctttataaaacaaatactctgtgatatacctaaagcttatgtttcatagactttttaaaaagagggctgattgtcttaagttactgatatggggaaaaattattttcactggctaagacatgtctaaggcatcaagaaaagattcctgaatgttaaaacataaaattggaatataagcataggtactaaactgccaactagctaaaatcaggttgttggaataatgcttatagtaaacctataagtagtataaccttttagagtatctgggaatgacagatgggagcagagaggagtgccagtgcttctgtctcaccaacctacattctcttccaacttaccttacatttgtactcttccaaaatccttttctaagcaagattatggagccacaaaatggtgctaatgaatttctcctcattttgtgtatgtatatataaaataaaaaggtaatagaggaagtgctttactgacaaaaggggcaaaattcagaaagaatggagtggctgaaaacaagacctgctcagaggaaccctaaatattacaatgttctctgacaccgagcaggttacttaacctcccaggataatctgtagaatgagtgattgaaataaatcagccctgttccttctagctcaaaaacgaaagttccatattgtgaatagttgtcctagatcctgcaagtcttcaagtgctaatgtggtgtggctcttatcctgtcagctaatataggctccaatcttacatgtcctccagaaaatgcatgttcttgtgagtgacttaacagcaggcccccaaagctagttagtctcatttttcaaagacagtaatgtcagtacccttatatgggagaattaggcatactttgtgatgaggcaactggagttcccacagaatggcgtactgcagcttccccacgtgggatccatgttcccgttagataaagaagggcctactgtgtgtcaggtaccacactaactactttacatatgttactatattcatttattattcatttattcattattcttcacaataaccctgagaggtagggggattgtcctcattttacagatgaggaaatttcccaagaactaattagttggtggtggagctagtgaatggtaaaactgatttgaaacctcttatgaggggaatgaaaccagggatcccttcactaaacctgcccatcaaactagctaagggaaggaaaccaaaaagccttttactgcagttagctttatactcaccaacaatgacaagcaactgtggctcctctgcctgtgggacctggcccctgcagccagctcatgtgcccaagactccccctacccctaaatccagggtaagcatattccccctagcccttctgaagtctcaggtgaataccccagaactttcacaaggcttcccacctaggaaacctagccacctctaacctagaggatgtaactcttaagtttgatattaagaccctgctctagtagaatccttcaaagcaggaagcccttctgtgctgtttgtggtgctgagaggtgccagataacatgccaccctgccaactcgtgtaactcagggaagaacctacctgaagatgataagagaaatgaaaataaagtcttgaagaactacaattgtcaggtgatcctgcagaggagtccctggcccacaggagtttttttctacgtcagtaacttcaaagatagctgttaatacttctagatctccgaattcctgacaggagatgaaagagcatccaagtttaagattatcaggctcagaaactgccagaaataacttagaacagttctcaaagtatgttcctgggacaagcagcattagcctcacctgggaacttgttgaaaatacagactcttggccgggcatggtggctcacacctgtaatcccagcactttgggaggctgaggcaggcggatcacgaggtcaggagatcgagatcatcctggctaacacggtgaaaacccgtctctactaaaaatacaaaaaattagcagggcatggtggcaggcgcctgtagtcccagctacttgggaggctgaggcgggagaatggcgtgaacccaggaggcggagtttgcagtgagtcaagatcacgccactgcactccagcctgggcaacagagcgagactccatctcaaattatatatatacacacacacagactcttggaccccatcccagacctgcagaatgagaagtggagcccagaaatctgtgtttcaacaagattctgatgtatactaaattttgaaaacaactgtcctaggactatgaatgatgatcgcaggttccctacatcaaattgcaacagcttcctgggactagtcgaccgccccatctccaatatagtgccattcttagagatatgcagctctctcaaccaagactactgcctaggacctcatttgtttccttgaaaactcctaggaaaatattgggaaaaatggcagatgattggtaatgatagaattgaggtaaaaaaaattaattgtgtatgatgggggaattggaagtaatttatatgcctatttataggagtttgcctaaaagcaaattccatgaggattaggactaacactgaccaacagtatgttcactgtactctcattatctactatagtgtaagtatttaatatttgttgattgaatgaataaatgtacatatacatttcagtcctgaagtaaaatgcagccattaaaaaagatgtcttctattagcagtctcactcatatgtatgtactcaaaaacctgaaattcaatgtttatatcaactttattcataactaccaaaaactggaaacaaccctattgtctatcaactggtaaacagatcaacgaacattcatataatgtacatccatagaatagaatactactgagcaataaaaaggaccaaattacaaatatatgcagaaaacatggatgaattgcagcagcattaggctgagtgaaagaagccaggctcaaaaagcaaatgtatgattccatttatgtagcattgtagaaaaggcaaaactgggctgggcccagtggctcacgcctgtaatcctagcactttgtagggggccaaggtgggcagatcacctaaggtcaggagtttgagaccagcctggccaacatggtgaaaccccatctctactaaaaatacaaaaattagctgggcatggtggcacacccctgtaatcccagctattctggagactgaggcaggagaattgcttgagcctgggagatggaggttgcagtgagccgagatcgtgccactgcactccagcctggccgacagagtgagactctgtctccaaaaaaaaccaaaaaaggcaaaactgtagggattgaaaatagttcagtgattgctggagaaggagcaagtgcctctaaactacaatcaggcacaaagacagtttgagggtgatggacctgttctatatcttgatcgtgatggttgcattattgtatgcattcatcaaaactcatgggactgaatgctaaaaaaggttaattttactgtacatactcaatatacaatatactgtgtatactcaatatacttttttaaaaagtatactaacgtttttaaaaaatgatgttgaataaatgtacctgatacatatgtaatagaaaagtcaagttaaatgtttttctaaaaacaaaacaaatgtcatccatatacatgtgtgtaagttcatgtgtatctctgggttatataaatttatttaaatgcctagaacaagatgtgaaagaatatacttcaaacttataatggcaattacctctaagaagggactaaatttggtgaagtgatttgagaccttagtttatgggttgctgtttgaattatttataatatatttctgtattgtataattaagaagtaaacaacattttagagaatagaaggataaacaccaaaaatgtcaatagtagttatctctggctggtggagctataaatgtcttttattttatttttttctttcttttttttttggtctgagacagtgtctgttgcccaggctggagtgcagtggtgcaatctcagctcactgcagcctcgacctcccaggctcaagctatcctcccacatcagcttcctgagtagttgggactagaggcccatatcaccatgcctggctaattttttgtattttttgtagagatgggttttgccatcttgcccaggctggtcttgaactcctgagcgcaagcgatccacctgcctcggcctcccaaagtgctgggattacaggcgtgagccaccctatctggcctattttatttttgcttatttgtattttctaatgtttctatagtatgaacaagttatgcttttgtaactaaaaaaaaaaaaggttatcttaaaatacaggggtgagggacccagcaagcatacacatattaaaagcttgtacatattagaaatgtagacgttacaaaaatattcaagacaaagtttcactgaaaaagaatttgagaaaaagaatttgaatactcctagaatagtgcttctcaaacatgatgtccatacaaatcacctggagtgcttgttgaaatgcatattatgattccaaggatttgcatttctgacaagcttcctcttgattccagtgctactggtccatggaccacactgaatatcaaggctttaaaactgtgctctcaatacagcagccactaactagccacgtaaggctgttaagcacttgaaatgtggctagtccaaattgagatatactgttaagtgtaaatacacattggattttgaagacaatttttataaaagaataacatcttaatcattgttttatactaattacatattgaaactattttggacacattgtgttaaatagatattaaaattaatttcaccctttttttactattttaatgtagttaaaatagattttaactacatttaataatgtaattttaataatgtaaagatttaaataatgtaatttaatgtagttactagaaaattttaaattttatttgtggtttgtatttttggcttgtatcatattgctattggacagcactggtctagaataactgttaataggattttacttgtattagcttcacattgggtcttaaatcaacagcgtaatgcaggaaaaggattagcaccccattaaagaccaaattgacaacttctgtgtattaatatgaacatacctaggaattctcaaaatttataggtagaagttgagacaaatagaaataatagaattttgacctggaaaggaactttgatgtcatcaagttcaaaccccttgtcttacagaattatttatcaacctggcaaagatatatttggtacttaaggcattctaggtaagtattgaataggtatgtctgtgataggtgagtaaggtgagatgcctaccctggagaagctaagaaggattgtattagactgtaacagcacttactaggcatgctgacaggagtgctctcaaacacagaggcagaggcaaatacgggctcaaatttttgttttgttttgttttgagacagagtctcactttgtcgcccaggctggagtgcagtgacacgatctctgctcactgcaacccttcgcttcctggattgaagcgattctcctgccccaccctcccaagtagctgggattataggcacccatcaccacacctggctaatttttgtatttttagtagaaatggggtttctccatgttggccgggctggtctcaaattcctgacctcaagtgatccccccaacttggctggattacaggcgtgagccaccatgcctggccagactaaatttttttttaggaagaatcagagacgctccagcactttgggaggccaaggcaggcggatcacgaggtcaggagatggagaccatcttggctaacaaggtgaaaccccgtctctactaaaaatacaaaaaattagctgggcgtggtggcgggcacctgtagtcccagctactagggaggctgaggcaggagaattgctggaacctgtgaggtggaggttgcagtgagccgagatcatgccattgcactccagcctgggcgacagagcgagactccatctcaaaaaaaaaaaaaaaaaaaaagaatcagagaagctccactcaaggaaactttaagtttccccaggctttatagcttctgttttaaattaatggtacaaataaggctttaggattaattatttacttaaaaatcaatgtagaacatgctgttccgtgtcttttcccacacaaaatagatatgtcctctattatcagagggcaaagaaatttagacctgagacactttgaaagtttgaacagggttgatggtacagatggtaccagaatgaaatttggagtgtagcagtagcatagtcaaccttcaattatatgtgcaaatgagggacaagaattgctgagatgattaaaagcatgaataaaacaaaacgcttattttagctattattttaaaagacttattcatcaggaatatcttataccagaggctttatgacagaaatttgttcttgagttacatttcccttctgtgaaagattgaaaagacaaatttgggataaataataaagaatgtgattatgaaaattcttattactttgaggtagaatgggctgaaaatatgaatagcccttttatttatttttttttttagttaaaatctgggtccccctcataatatttcattcatttataatatattagtaaagggatccaggtttctttggtatgtattctttttttcttttcctttttctttttttttttttttctgagacagtcttgctgttgcccaggctggagtacaatggtgccatctcagctcactgcaatccacctccagggttcaagtgattctcctgcctcagcttcccaagtagctgggattacaggcacaccaccacacctggctaatttttgtatttttagtagagacaggttttcgccatgttggccaggttggtctcaaactcctggcctcaagtgatctgcctgcctcagcctcccagagtcctgggattataggcatgagccactgtgcccggcctggcatgtattcttaacttgtagggaaattacttcagagcacaagcctcgctcattacatgtacagactcctggccctcgtgatcatggaatggccctaatttgaacatttgtattattcactctcagccaatatttaaaaaattatctagatttgagaacagtcaaacctacctgagaatggcatcatggactttgtccaagagtgaaaactgcctacagccattcaaaaccaaaatttgaactaagcagaataaatggttctacctaagaattataacattttcctctgttcttaagaggaatcagaacagcatttttaaacttttaaatgttttctaggaaccagtgacttagtttggttaattttgcttcattcataccaaaaaaaaaagagggtattgagtctttggttggttttgaatattcccaaggattattttttgacatctcgttcccatacatgaacagtagttacttatgggaagtggcctaattttcttaaataataatctaccataacacacacacacacacacacacacacacagaaaaaaatcattactttattgttaaaaatgtgtcagttgtaaagatacctgtcctttgaatcagcatgttgggaggtgcaggagattcctgcctttgaacacctgcctaaagattccataacaaggggatttggtatgatgagatatatgcaaaaggtttggattctggaaaaatatatacaagtctttttccagggggggaaaatacacacacacacacacacacacacccctaaggagtccagtgtaattttgtttctcaaattcctgtttctcaaatacaaagttttaggagaataagacaatttaggaaaatcaacacattattcatgtcccgtaaaacaccaagattgtttttctattttcctgagttatatcaatagaaaaaacataaaatgataattagtctccctgtcacttcatcagagttttatagattagtaattttcatgtatagcacatttatgatataacttatacccttatttattggagatgattttattagatgatacctgcagactatggaaaaaaaaatcttttctaagctttctatatgaggtggtcattagaatgcttcatgggatttttgaaaacatttctaatattccagcctctgacaataagcactttttcctctatgacattaatttactccttaaagttttctcttcagctataatcttaaggtaaatgggaaatagacataagtgcatttaaatttataatgcactgattctcttgtgaaggtagtcttgtaatgaggaaggaattcaaaacagaacttgtttgcagctctgcaaatgtgcaagaaagctacaaacctgccaatattccattcacatttagctacacatttctgagacacatctatctttactagagggcaggatttgctatctctctggagtagcatatgcataataaagatggacagagattgataattacttgcatcaaaatgatgctttctttgtgtacctaaatttaggaacaaaatgttagaaaattgtttcaaaagtgcctaggttaaaaataccaactatatcaaacctaatctacttattctcctgctctcctcatccaccgcttcataccttctcatcctcaagccacaagtactttttctcctatcttcctttgcagtgttacttactatttccctgagaaatagaagtaatcagaggacttccacagaccacctccccccaccaccatatagagtcacctacttgtaactgtgccttgtattctctgtcttccatctgttcttatgaatgaaatgttccgagctgtatccttgcaacttgtgcactagatcccattccttcccctactcaaagagtgattcagcaactttctcctctcccctgcagcatcactcccaccctctctattgggtcattcccacaaccagcttggtggaagcaacaatcagcccgctcccggattcttgcagtagcctcctacctggtctccttttagcccctgctccctttcactttattttcatcgcaatagccagaatgattccattaaaatccactcttgctcagaaccctccagaggcttctcattcactaagtataaaagttaaaatctctaaagaaaaaaaaaaaaatccaaccctacttggtcttccctgccctctacctcttcttacttctctaacctaatatcttactcctctccctcagctctttctgcaccagccacactgattttatttttcctagaacaccctggctagaacttccatctagccccagattttctagtttcctagaacccccactgcttgccctagattttcatctagcttgttccctttcccttttttgacctttcatctttcatatcatcagtgaggcctttcctgcccactcattagaagtataactgcccccacctcccctactctatttttctcagttacacttgtctccatgttgtgaaataccatatatttttacttgttaattgttgtctatagtctgtcacccccctcaaccctaccccaggtaaggtgcttgagtggttgggatttttttttcctttttactcccctcccatattactggtgtattcctagaacatagtaggtacttaccaatatttgttgaaagaatgaatctataatagagtataattggaaaatgacttaggagtatcagtcatgcagactgaatttttttaaatctgtttcaccaattctgtttttgtttgtttgtttgtttgttttattttgaagatagggtctcactctgttgcccaggctggagtgcagtggtgtgatctcggctcactgcaacctccacctcccaggttcagacgattctcctgtctcagccccccaggtggctgggactataggcatgcaccatcactcccagctaatttttgtacttttggtagagacaggtttttcccatgttgtccaggttggtcttgaactcctagcctcaagtgatctgccttccaaactgctgggattacaggcatgagccaccacaccggactcaattctgctttataaacataatttaaatacggttttagcttcaggtgagtcactataggcattcgtctttctagaaattgtgggactctccctcttatatgcagttgacccttgaacaacacgtttaactatgtgggtccacttacacgcaaaattttttttttttttaagagacaaggtctccctcttgttacacaggctggagtacagtggtgccatcatagctcactgcagcctcgatctcctgggctcaagggatcctcctgcctcagcctcctgagtagctgggactacaggttcacgccaccatgcccagctaattttttcttttttattttgtagagatagtgtcttgctatgttgcccaaactggtctcaaactcttggcctcaagcgatcctcctgccttgtcctccccaagtgctgggatttacacacatgcaccatgatgcccagcccacagattttttttttcaataaatacttcggaaatttctttggagatttttgacaatttgaaaaaacttgcaggtaaatgtgtaacctagaaatattgaagaaattaagaaaaaggtgtgttatgaatgcataaaatatatgtacatactagtctattttataatttactaacataaaatatatacaagtccactataaaatttaaaatttatcaaaccttacacccagaccatactatggaagattcctagtggaaggaaatggaaataaacagtattaagtcataactgcgtaaaattaactgtactagtgtaatagttttgtagcaacctcctgttgctgttgcagtgagcttaagtgttgggagtatccatttaaaattctatgtgatgctaatcaatcatctctgagtgaacagttcgcctccagtaaattgcatatctcagtaaaaagtgatctctaggggttctcgagtattttttttttatcttgtttagttcaatgctataaaccttggatgtatgggaccatggggcccatatgaagtgccaccagtgatgctagaaatgctcccaataagcagagaaaagtcaagacattaccagaaaaggttgaattccttgatatgcaccatagattgaggtctgcagctgcaattgcctgccatttctagatgaatgaattcagcctaaagaccactgtaaaaagacacagtggctcatgactgtaatcccatgctttggaaggctgaggtgggaggatcacttgagtccaggagttcaagaccagcctgagcaacatagcaagactcctgtctctatggaaaataaaataaaataagtctcatgttaaaaaaaaaaaaaaaaaagccaagcatggaggtgtgcttgtagtacttgtagttcaggaggctgtgctgcagtgaactgtgattgcaccactgcactccagcctgggcaacagcaagatcctgtctcttaaataaaagaaaagggaacttgggaaggcattgctgcagctatgccagtgggcatgaaaactttacactttttgcaaaatacaaaatatgtattaatggactgtttatgttatgggtaaagcttcaggtcaatggtagactattagtagttaagtttcaggagaatcaaaagttatatgcagattttcagctgcatggtgtggggaccccccccccccgccgcccgcattgttcaagggtcaactgtactttaaaagaagtataccatgagaaaagtatgtattttaatactttttgaacttttatactttcaatacattgctgttaaaaattactttagttcaatgtagacattcagatatttatagttattcttcttatggtccctattcagagatgatctgctataaatttccctctaagtgctgttttaactgcattacacacattttgatatgttgtcttttcattatcattcaattcaaaatatttttctataattttcattgcaatttctttagttattttaagttgcttaatttccaaatatttgggaattttgcagatatattttctattgatttctaatttaattttaattttattttatactcagaacccatgtttttataatgccaattcttttaaattttttgaaacttgctcagtggcaactaacactctgacaactgccagatacacattttttttcccagtgcacatgaaacattcatcaagaaagaccattgtcttttcatgttttccattatatcttgaacatatttatactagctattctaaggcttttcctattccgtcatctttgtcaattctgagtctgtttttactgactaatgttatcctagttatggggtatgtttccttgctactttttatgtctaataattttttactggtgttggacattgtgattaccatgtagttgtgtgtctgtattttatcttgtttccaagaacattcagttccagcagatagttgaaggtcaacttgatcctttgaagcttgttttatgctttcttaagatggttttaaagcagaagatgacaacgtttttatttaacgagccagatagtattttagcttctacagtttcttttgcgtatttgtgtgtacaacaccttaaaaatgtaaaaaacatcttttgcttgtgacccatacaaaaccaggctgtgggttggatttggcctgtgggctggagccaccaattgctgttctaaagaattctttagggctactttagccatacttttgttattaaatactcctctgtcgagtcagagactattcagggtctgagattttaccctactttgaagccagtaaatgagcttgccacagtttaacagatgctggcagaagacatgagactcctaggtcagaaacagacaaccttattattcacagtacagcaaatagcatgggctttatgttctcttggttttccttgttctccaaaccaagacaatgaggacaatgtgagtgggtccaggtaaatgctacacatacagttggtctgtgtcacatctgaggagccccaagcttaggaaacccctaatcttataaggtaaccgctagtaaatctgccacactttgtcctggaagaagccattcactttatttttctggtcaggaaacaaatctgtcctctgtgctggagggtgacactatgccttccaaaggtgttggctagacaaacatcctttgaaagatagtctaggtcaaaatttgtcacaagacacacagaaatgccgtggagaattgttgcttagcacccacatgttcaagaggcatttccactggttgtaactcaaatgcttgtcagccctgtgaaagtgttgctgaggtctcagtgccccagtagttcttcctctgagagttgttctaatagttgttctctgcctggccttacatagtcccattttatggatgtacatcttagtattcacgtagactcaagatgatttttatgcagatttctggagctctgtctcttgacagctttctcttctcttgtggtgctctctttctcaaattgtggttgccctcctaagttcctgtctctctcttaagcccagcaaaaccactgtactctgcttaggttctccttctttgtatatcagtcgatagagtgcctccaggcagaaggctggaactcagttcatttttctttcccaagggatcacagtcctcctgtactacctgttgttcagattttcaaagcggttactttatatattttgtctacttttactattttttatagcagatgctagtcccatattagttactccatcattgattcttttgtttgtttgtttgtttgtttgttttttaaacagagtctggctgtcaccaggctggagtgcagtggcgagatctcggctcactgaaacctccgcctcctaggttcaagcgactctcctgcctcagcctccctagtagctgggactacaggcatgtgccaccacgcccagctaatttttgtatttttagtagagatggtgtttcaccacgatgtccaggatggtctcaatctcctggcctcatgatccgcctgccttggcctcgcaaagtgctgggattacaggcgtgagccaccgtgcccggcctgattctgtctttttagcatttacttctttataagttttaggattttgattagcataatcactttgagtgggagatatttttgttgtcaccctttcttggcctgtctccaagtttgatgaatatttctatctgcccttttcctcattccatatcccagtccagagccagttcttaaaatggctttagagggctcctactccttactgatatccggaatatggccaattcagtaactgaaccagctgttagctcagctcagttgctgtagtgatgtttttcttttgtcattttgccctcttgggtccaaagcttcccataaatgcacagccccaggcagaatcagaagcagtttaatttagcctcctttcatgagactggggaaaaccaggtgacaaaccactgtttgcctggaactaaagggtttcttgggatttgggatgatcagtgctaaaacaggaagagtcctaggaaaaccaggaaggctgatcacctcagtcatgccccagtttctggcttccagtaacatggctggcattggtcttcatctttagcagagcattttagtctgtgtattccacaagagctgagtttccagttgccactagctgcctcaagacccagaccctgatcgactacagctctagcccagcttactgctttgcatttctattgtgtttctggtccacaaagatgttagttttgttttttaaacccaacaatggccttttagttttctttttttctgttttatctctcattaccatgtgtttagagcatataagataagctgaaacatgaatttactgtgccaccttgtttggaaattctactgattctttttcaatttgatattgtcttggcttaggaaataatgtaatttaactgcctgctttattgagaaacgctcccaactctccctctcattttgagggatctcaaatcacagaaattcaggtgaaatattgtcattttccatatagtggtttaattgtttctttgagggcatcgtaactcagtgctggagttagaatagaacagggatagtatcccagctttgctccctcctacatctggttgatgagaatggtatcagacagtgctttgtgtccccacctcctccccatctctgcttcgagctgctctctctccttttcctattcctccatgggccctttttttatgcaaccttcaatctgttattggagaatacgtggattttcagaccctttgtcataacttggtagcctttccagagtgttactgcctctgaacttgggcaagaggaggaagaaaagccttcctacttgtttatttgcctcgaactatgctctatgttcttttagatgcaaatattttaaaaaacaattttcaatcttttgctctttcatgctgttgccaataacaatctagggaactgtcagtgaactgcattgtgatttacactaggcatttaaaatatttccaatggattaaagagtttttgaacatagggggtttcacatttcaagcccaaatacctaaatataattgcacactatgctcctgtcagtatacttgctggagcaaagtagttcacagcaaccagcttagctctacttagaaaagacttgcttaggaataattgaagtggtagaaatgtgtatgtggtcatcctcattgagacatttagaaactggtattgcatatggtgtcatcctctttaagccactctgtttttaacaaaaatgaaataaatatgtgagtttacagctcacatgaaggaattaaacattttctgggaggtaatttaataaaaatcagatgattcaagaaatggttaccttcatgttttgtttatttgtttgttttgttaaagaaactagttggaaaaatgctttgttcggatatcttaaaataactccataggtagctgttctgtgattgccgacttggggtgtggaaaagttacaaaatgaaatagagagctattatttagcaattaagaacacactttgcttctttaactgggattaagtacttctggagcaagttttgtgctaacattagacattgaggttggtccaatagctgcacaagttattctttagaaactgtagtctgttagttcaaatcaggacaccgcagtgtgaatataaatcacttatgccacattcttacgaggtcattaaaccataattgtcacaatttctttagaattaccaaagcaagaatttcctctgtgtaacgtttgagctttatttttttttctttttgtttttctttcatgtattggaagactcttttaaaatgatatttagccaggcgcggtggctcacgcctgtaatcccagcactgtgggaggccgaggcgggtgggatcacgaggtcaggagatcgagaccacagtgaaacccggtctctactaaaaatacaaaaaattagccgagcgcggtggcaggcgcctgtagtcccagctactcaggaggctggggcaagagaatggcgtgaatccgggaggcggagcttccagtgagccgagatcgtgccactgcactccagcctgggcgacagagtgagactctgtcttaaaaaataataataaaaaaagatatttaattttctaatgccctggcttctatcatccctcgcctataaaatagatgtatgtactaggaagcaggtattgcgtgagtgtactgtgaacagcatactagaacccattggttttaggaaattaatgagaaaggtaatgtggtatagtggaaagagaatgcgtcttggagtcaggcaaacccacctgtgaatccagctccaccatactctctgtataaccttagcaaaattgctttgtttctatgggcctcagtttctttatctggtttaaaaaagaaagaagaaaatgttaggtgctaagaaaatgttactccactgtccctacccttctcagaagacatttagatagatagctagacagacagatggaatgttattaactgaatgcttattatgtgcctgacattgggctccacatctcatttagtcctaacacacatacgaagcactggagcttatacagcctttgtatatgtcttcaggcttgacttgcctgaagttacataactaggaagtagtagagccaaactactgtacagcacagtgctcttagctactgtgattttagcttcacaaaatttaaaatctcttagagatatcctaccagtttaatgctgttagaaaatgtaatgacagccaggcacggtggttcacacctgtaattccagcactttgggaggccaaggcggatggatcacagggtcaggagatcgagaccatcctgactaacacggtgaaaccccgtctctactaaaaatgcaaaaaaaaattagccgggcatggtggtgggcgcctgtagtcccagctacttgggaggctgaggcaggagaatggcgtgaacccgggaggcggagttgcagtgagccgagactgcaccactgcactccagcctgggcgacagagcaagactacatctcaaaaaaaaaaaaaaaaaaaagagagagaaaatgtaatgacaaaccactagtttctcatcatatttatttttttctgtccatatttaattttgatgcatgtatttgctagagctgccgtaacaaagtaccacaaactgggtggcttaagctgcagaaaattattttcttataattctggaggcaagaagtccaagctaaaggtgttgacaggtttgcttttttccgtggtctctcttcttgacttgcagatgactgctgctatggtctgagtatttatgtccccacaaatgcatatgttgaaatcctaaccttaaggtaatgacataaggaaatggggactttgggagtgattatgtcatgaagtcaaagccctcacgagtgagatttgttcccttataagatgggcccaaagcgaccactcacgctttccaccatgtgaagacagggcaagaaggcaccgcctgtgaggaaatgggtccttagcagacactgaatctgccagcaccatggtcttggactttctggcctccaaactttgagaaataattgtgtgttttttgtaagatatccagtttatggtattttgttatagcagcctgagcaggctaagacagctgtcttcttgctgtgccttcatatggttgtccttctgtgcatgttatctgtgtcttcatctcctcttctatgtagacaccagtcctattggattacagctcaccataacaattccattttatcttaattacctctttaaaggccctgtctctaaatatagtcatgttctgaagtactgcaggttagggcttcaacttgggaatttggggaggacatattcagcccataacaatgcatatatagcataaagcatatgaaaataagagcacctaccctccattgtgtgtttaccatgtgtgagacactgttcgaaacactctatacatgtgtatttaacccatatgaggataggtactatccttatcctcatttgttactgggaggctaggtagtctgtccagggtcacattactagtaagtgaaataggatttgaagctctacagtctaactccagaatctgaacttttatgcagtatatatactgcccatcacaaaaacaagaaatatccagtttggagcaaagaaacagaagacacagtaatatctatttgaggtaaaattatgattaacttgaaaattctgtatatgtttaattagcagttactaggttgtcatatgtgagaaataaagaagcagcttcattcttctttgccattgaaaatcatggcaaaaaccgctattacttttgcaccaatgtaatactatagcacaagtaataagtcagagtcatttaaaaaataggaaagaaaattccaagtaaatttctggcatgctactctatataataaagggttaattaatacaaaatattcttctaaaatttcaaaagcaaatagtacccacaataaagttttaatatttgaagacctagtacacacatgccttacttcttggctttttgtcaaagttgatatcactccagcttcagcccgttttactgatgcagaaaaaagagctgagtttcacatctgggagatatggggctcagggacagcaatatgccccttccagtctccgaactaagcatacaaaagcaaagaacttggacctaacggtgactagaaaagaaattgtaaaccatccatattccctccctgaacccccaaacagtgaggaaggaatatagggctccctctacacaaagaaacaggatttgagccaatttaattgagtgtcaaaggacagcattccttaccttctatctggtttaaaaccaaagtaaagaaacagatttcggggtaggaaacactgctatggtgctccctttttgccaatcactttgtgtcaacaaagcctctgccttcaagatgcgtgaaacctggtgactgggggggatttacaaagatgagataatgagaattaacagagctcatagtcaagttctaagttaaaaataatcaaatatgaaaatgttgagtggagacattgttatggctggtcaggattttggaggccactatgactggagttatcaagacaaatgatgtagaaaaggtgggttttgagatggaccttgaaagatgggatagtttgtggtggaaagaagaggcatcttagacaggattcaacatcagctgggcatgaaggcaggaacgagggaagtatgtggaagcgatgaggagacctcacctctggaaaagataggtttgggggagtaatgggatatactttataagtagatagagtggggtcagattattaatatggctgcatgctgaagtctggcattattattctattagttgaattgctcagtgaaattatctcaattctctaaacatgcttgtaagaatacatctcaacaaaacttagcattttggattaagtagtgtgtttgttaagtctgctcggatcacaacatactctatggaccactggcccttcctgattctctactcaaagttgtgtcatgcctaattaggctaggagatcaagcagtcctgtgccttcactcacccctggccagaggccttggaagaagctttaagtgattctaagtggctgactagagttgccaggagagtgccactgccctgtgaaggcatatagcctaagaaatgacttaaacttggctgggtgcggtggctcatgcctgtaatcccagcactttgggaggccaaagcggacagatcacttgaggctgagagttcgagaccagccttaccaatgtggtaaaaccccatctctactaaaaaatacaaaaattagctgggtgtggtggtgcacacctgcagccccagctactcgggaggctgaggcatgagaattgcttgaactcaggagatggagattgcagtgagctgagatcatggcactgcactccagcctgggcaacagagcaagagtccgtcttagaaaaaaaaaaagaaaaaagaaagaaatggcttaaacttttttgaaccagtgatatgtgcgatctctgcattttataaatcttaaaagggaggaaccctatagaattctcagatccccatgccattttgtgataatagaaagcagctttggagtctcacagaccttaatctgaagtctgtgtgacttcgggcaaattaccaaattgtatgagcctgttttattttttaatctataaaacagccccgtaactatgcagttattgttaactttctttttttccttttgtgacttctctcagttcctgacatttttgaagaacatctttgtctaatctaaatgccctctactgccaaggagttgaaaactactctttaggatccctgtggatcctcaagaaaacatggggatgtcaataaagttggcctgccccaaccctccctctctccctccccactcatgtatttatttcctcagggtaggattttaagtcaatcagccaatccttaggatagtacagagttcagtagggttcagagttccaggaaatgatctcagagtgggtagatcaactacccttacgtgtactgagtctaaaacaagaaataatgacttaaagtcattatatggcctaaagcatgtaaacattaaggttacacgtgacaaagcactttttgagttcacaaacagttgggcaaggccataaactatcacattactaaattgctaccatttctaatgttcaaggttccaactacaagtttgtccttagaagttgccttagaaattacaatgtgctgtcagtaatttgggtgtatccaattgtgcttgcagctaagaaacacatagggtttgccggttcgtattttgcctatatttgaatcctgaaaataaccacttcataagaacagaatgagctttgtgaagattatatcacagttggttagaaatggaaggtacatttttcttaccccctcttgcctttcatctctaaacacatttgcccctactctgaagtacaggcgactatgagagcagctgcggtaggcagctgtagcatcttctgcgtcatctgctcctatgctccgcagactctgtcctcatcctccgctcccagttgcccttttcttcctttcaaaatggcccgctgccctcttctgttcagtgccccacctggggtctggcagtgtccctgcagtgatttcaggggattttgcctggtgtcctcttacttttagcattctgtatggtaaaaagatcattagtgaaaacattgtatcttatttaaaaaaactagaaagaaaaaagcgtttatcagctaatatacagcggcttgctgctgcctccacaagtgctgcctgttgattttggtgatgcgctctaccctatcagtacaatagaacacgcagaggaccgatgattatgagtctttgaggagaagccctccacaggattgcgttgagagaaatgacttattcatcctatgcacatagggtagtaaaccactgtcccagaggcagttctctaactttccacaaagtgcttatggactggccaagccactcccaacatttctctcagtgcacaataaactgttataaccagcagctatggaatccctttctttaaaaaagcagagttgagcataagctattctgtaaggtagaatataggaggtagtgcaggatacattcctttgtgcaatatgataaaggaatttatgctccatggcacttagggaagagccagctcattttagactggtccttttaatgttgtttgattttgtacacttggaaaatgggcttgcattctttttctctttttgaaaaagctattatgttgttttaaaacatacatattttaggctttaggtaatattcaaattctaatttaaaacaaagtattacttaatatatttgattgataacacattacatgcaccatgcatggaaagcaagtaaaaacaaattgtatgttttattgtactatatgggcaacagggtagcctgccttacaaaacaatataaatcatcttttaccactgctctccaaaaataatttggagtttacacaatccaaattgcacctgccagaactgccagcaatatcttcaattttcactgactatactttcctttcactccctccatatatttagacaaatggaacagatatttcagccacacagtttacacaataaaaaacaaaggttgaaataaaggaaaggaatgtattaaattaactttgggcatgtgagtgtatagatgctagcatccatagcatataaatacacaggtgaaatatacctaaaataaggtggtttgtgtgtatcagactgaatatgcaggtgtggtgtacacagatgtgtacatgccaaactgccgattttctcacgtaagtatagcagtttcaatacctagcagtgaatgttaatgtattttgagaaaaagaatttgtctccttaaatattacaatatacaataagcatgtatttgttataaatataaaaataatgtgcttgaaatgctaattaattagattggagagtacatactttgtgaggaatagataaaaaactagaacaattagacctcagcctgggcaactgtgaaaatataaactcacagaagctctgagctggaaggatttgatcagggcctctacaatctaaatcttattaaaggcatgaattgtctttgcaacatcccagtaaagtggtcattctgcacttgttatacttttggtgtagggatactcagtgcttaccaacacagtcaccttcaagttcttgggttttttttttttaattgaagcagggtctccatctgttacccaggctggagtgcagtggtgcgatgatggctcactgcagcctcgaactcctggactcaagtgatcctcccacttcagcctccctagtagccaggactagaggcacaagccacaacactggttaatttttgtattttttgtagagacagggcttcaccatgttgcccaggctggtctcaaactcctgggctcaagtgatcccccaacttcagccttccgagtatatatactcagaagtatatataggtatatatgggattataggtgtgagccaccacacctggccctcaagttcttatttagggaaaatatatttacctgtaatggtgtaatctatatatccatttggttctcattcttcccctccaccctatacagaataaacatccctcctacaatccttcagatatgtgaagacaatcatcatgtcataactgttctataactgagccatcactaacaaagacttgtctcctaagcctatcagagccaggatgtttattcatccttgccactcagcaactgaaagatcctcatctctagagtagattggtggtggtacttctcagatgaaaagcctgtgatgtggttgtgttgtgttgatgagttactgctgaagacactagagccagagaggaaatcctaatcctagagcccaggcaagagccgcagatttgaattaagttggtggcagcaaaggcagggaccatgatgttttacctgcaccaaaaaacaaaaccaagaactttcaatttgtgtcattgacattcaactgagcctgtaattttctagttatggccttgagctccattttactggcagctctgccactggccagatgcatacccttgggcaatcctcctcactgctcccgggttcctctctgttatgcaaaggcacatgctgcttttctgcctagtaaacaacaccccccctccccccccccgcccacagctaagatgtcatttctccaggaaccctttcctaactcctacccctcactccaagactggcctctgtcttccgatgcacccaatgctcacctctattcacttacttcattgtattttaatcacctatttacttgtctgtctctactgtactggaagttctttaacactgaggactcagtccctagcacttaactcagtgcttcgcatataccagaactcagaaaaaaatttgttgaaaaaaggaagaaaggaaagtgaaaaggaagagagatgataaaattaggaagttggactaaattatctaagtacctcttacagctaaactctatggtgctttgttcttaggtgctatatttaatgacaacctgagatttttggaaatttagatttctctagtaagagaatgggtttcaagtgattgtaccaaaataggaaaactataaatatatattcatacatatagtaaaatgttaagactgagatttagaattcatttaatgagcccaaattgtattttatgtatgagtaaactgaggcacagtaagactaagttaactgcccaaactcttccacctggttagtgggaaaataacatttccaaccctgatctttctggttcctgaaccaggatagctggactgtacttccccatttttgaaaaagctgctaaaaacttggttacaaactttaagtgacacgtttctccatttatgtggtggttatagcaacgtacaactctctatttataaattaaaccttgagaaacacccatctccactcctagacaaaccaatgaacattagtcttatttttctcccagaaatgtcagagggtgttacagtgctacacgagatgactcctgcaagttgcttgctagatagagttgcagttcatgtgaattgctttcagccaggttgggtatccaagctcaatgttctggtgttaagccatagggaagtgttgccatgagaccagcttcttggcaagtagccctgaggtgcagctgtaaggtgacccagtgcagtcctgaggccagagccctgtgctcagtgccagaaaacttgagccaaactttggaactaattcccagggcactgaaattggtctcaattaaaattttagatgaaaagggtttttgtttgtcctgaagaaccacttcaatttataaactcatagagaaagtagatattttgccggtgtacttggaatacctttcagaagccaaacccttaaaaaaaaaaaagacattagattatttaagaagttataaatttttttctttttcttctgtattttaataggtacgaaccataatatatatatatatagttttttttttttttttttttttttttttgagacggagtctccctccgttgcccaggctggagtgcggtggcgtgatttcggctcactgcaacttccgcccaccaggttcaagcgattatcttgcctcagcctcccgagtagctgggactacaggctcctgccaccacgcccggctaattttttgtatttttagtagagactgggtttcaccgtgtcagccaggatggtctcgatctcctgacctcatgatccccccacctcatcctcccaaagtgctgggattacaggcgtgagccaccatgcctggccggaaatatttcttgaaagcagcacttttcataagattcactggctgaagaatctttatttttctgtctttgagcatgctgtgtaagatgtaaatcttcttcaaatgtaaagtggtattggagtggaaatggtggaagtagtggtcaaggtgatggtgataactgcactagactttgaacccatacagatttgaatttggaacccagcttcactacctactagcagctgacgacttagatagtatacttaagcatggagactattgtgcatggaactggttctcaaactagttgcagtggaatcacctggatgcttctacagagtatccctccctggattccactttagactaattaattcagaatctctgcaagtgggacccaagcatgaatattttgtgaacattctcataaagattctaatgttgaggaccagtgacatagtgattaaaactttggctctggagtctaactgggctcagactccaggttgaacctgtctgagcttcaatattttcatctgtaaaattggataataagagtttaggggctgggcacggtggcacacgcctgtaatcccagatctttgggaagctgaggcggggggatcacgaggtcaggagatcgagaccatcctggctaacatggtgaaaccccatctctactaaaaaaaaaaaaaccaaaaatttagctgggcgtggtagcgggcacctgtagtcccagctgctcgggaggctgaggcagaggattgcctgaacccgggaggcagaggttgcagtgagctgagatcatgccactgccctccagcctgggcaacagagcgagactccatctcaaaaaataaaaaataaaaaagagtttagtgtagggctgttagaagattaagtcatggaaagtacaatacagtacctatggcatagtaagtgttcaattatagcacctattgttatcatccgtaattccttcaattcatattgcatatgaatacttgttctcacttcagctttgacttaaaattcatctccccaaatcagttgtgagccctaccaagtccattatgataatcttttgtgcctttgacattttttctgtatctgctactaacaacctcgttaaagtgattgctatttatttccattgctatcctttgccaaccttcagtctttttttcagagagagggtctcactctagcccaggctggagtgcagtggtgcgacctcagctcactgcagcctcgacctcccaggctcaagcctctcaagtagctgggatcacaggtgcatgccaccatgcccggccaatttttgtatttcttgtagagacagggttttgccatgttgcccaggctgaccttgaactcctgagctcaagtgattcacctgcctcagcctcccaaagtgctgggattacaggtgtgagtcactgtacctggcccacctgcagtctttacaggcccctgtgttgccttcacaacttttaccagatggcttttttcttaatccacatactctggacaaagataagagacatagtgtggtattatgaagaactaaggaaccaagaaaaccagggtcctggtcccagttttgtgaccatggacaagtcttgtatccctcttaggctttcatctccctatttataactttaggaagttggaccggctgatttcttcctgccctaacattgtctggtggttggatgcaggggctattgcacatattgcctagtgtgtcagaggaacacccagaaaggaggccagagtgccagagctgagggaaacaggggaagtggtcagagatcaggacagagaaaacaaggctgcttgtgtgaggccctaaaggacctgataaggactaaggtgtttactcagaggaagaagagaaaccaccagagagtttgggggagagaaactgtaagatattatataacccatttttattgagtgcttactctgttagattctattttcagcgctttatttgtaatcctcacaataatcgtatgagataggaaccacaatattccccattttacactgaggaaacaggaatccaaagaggttaagtaacttgcctaagatcacatggctcagaaggacttaggtagaatttagacccaggcagacttactcatctcattcattgtcctgaccccccaactgcttaagagattgagactgaggtgttttttttctttctgtatttccagaggacacttagaataaaattaattcatactcattcataaatacaaaacttctttacttaaactgataacaatttcaagtatttggctttatgatttcaagttttttaaaaagccctcacattagcacattaacaagcctgttgatgtgtctctctttcattatgcagacagctatttcttttttgctcctaatgcagaggttgattgggaaattttttattttattgcttacgactttgcccttgtgctatctaaatcactactatatgatttggcatttataatttatcatttccctctgctattagacgaaatgccctttaaagcattccacagcaaggtgaacacaagtcaagcttgcaaagttttagaaaaaataattgcaaaaagtcattaaagaataatgaaagttgattgatatagcatacaatatcagggctgcccagtttaacagatacaattatttccagtcattttcagagggcatctaaatttcagcacctagttttcaccatctttctaggaataccagcaaaaatctcttgtttatataaaggctgtaaaagcaaaatttttaactcatttctttggattttcctaatgctaaggttgaaacaatagacattttaaatgattggaaaccagatttctcttactatcctgtgattttaacattctattgctgtagccaagagtctttgacttctggaccagctgctttttgcatgccgatttttcagagggagtccctcaagagttcttaacttttgactagtgtctaccttgacttcagcccctgcaggaagtgaaggtagcaatgtttgggaataaaaacactaagggaaaaacatctcctagtagaatcatcaactcagtctaattttagatttcaggcagaccacttagctgtactttcagctagttgcaaacatatgctttttaggtgctcatcattgaaggactaaaaccaggacttaaactaaaataataaaattttctatcataatatttttcagtaaaataggtgatatgtgagaacatgtgtgtgcacgtgcaaaccatgtgcttgtgcacccacattcaagtattcacagcattcaaaataagatgatccagtcaggcgctgtggctcacgcctgtaatcccagcactttgggaggccgaggtgggcagatcacctggggtcaggagtttgagaccagcctgaccaacatggagaaacccatctctactaaaaatacaaaattagccaggtgtggtgacatatgcctgtaatcccagctactcgggaggctgaggcaggagaatcgcttgaacctgggaggcggaggttgcggtgagccgagatcatgccattgcactccagactgggcaacaacagcaaaactccatctcaaaaaaaaaaaaaattagccaggcatgatggcgcgtgcctgtagtcccagctactcgggaggctgaggcaggagaatcgcttgaacccgggaggcagaggttgcagtgagctgagatcacgccactgcgctcccgtccggcaacagagtgagactgtctcaaaaaaatattagatgatccaaaagtgttcctatttttcataaactcttttaatttttttctttccacccatcacaaccacaaggactaatagccccaggctcaaaacctcagaagccatgttattgaggtatgtgacaggactacgagacatttttgataataagttttaggtggcagctattttgatattgaaaaaactggatcaaatctaacaaaggtcttttgagaggaaatgtttaaaagggcacatcttgtggccaggaaaaccacagtaaaatattccaattaggaataaattagagaacgctatactttcctagaaggatcagaaagtcaaatacttggccttgagctgcctctcacctctacccctgctgaccctaagaacaagtcactcctgtctgtgtgagcccaacagttgctgccaggccttgccattcctctgcagaaaagatccagggatttttcaccagagactgctggccagcatcagagtcagaaggaggtagccgaagtgccactgaactttctatagtgctctaaagccagctttctgtctgcaaaggaaaattctctaaactcactaaagccaaatctaacatactttaaagtctccaaaggaagtctcataaactttcttgttgctgttagaagattaagctctgatttcccagattatattttctattttccttaaatttagcaacatttaatccatgacactcattggtatacaagaaaaatcattctgctgtcttcatcatcaatttaaggtgttcagctgtgatgccttggtactttatgttgtgattaattgccttatactaacatctgatgaatatttttaaaaacattccttaggttacctatgtggctgaactgtgtggttagttgggaaactggggctatgaagtgagttccccaaagagctgaattcaatcgagatgtcatgcacaactgacctctttaatagagtattttactcttttgacagcatctaaaaccgacctttccctcagggtctagctcagtttctcctcctgcccaaaacctttcctgacaatttaagttcttactgacatctttcctctgggacacctaaagccctgtgatctgtgaagctgttatggcatttgggtatgtcatcatatgccatcatttattccctaacttttcaagtcaaaggccatatgcgctgccttttcagctccccctgcagtgcctagcatagtgcccagtacatatggaagctccatggtagaagtggattgaattggcttatagcctttttcatcattacctgaattatcatatctaggactagggtctgcattatttctttttatttttccagtcattatctgttccttagtgacccaggagcatccacagtgagttgcaagttggaccactcctggaataggttggtcaacttgtgttttttggcttgaacatcactgttctgtaccacacacagaaaacaggagacaaattatgtactttacgattgcagtattgcagtcattagagaatcaccaattagtataaaggcaaaaaaaaatgtatacatatatatatatataaaagctaatggaacagagaaagaaaagaaatatagaagagggtgacaggaaaagagatgagaaagaataaaaaagccagcaatccagttctctgatgtaatgtttcctttttctaatgacaaaacataaagactccttgcaagtgcatttaatggatgatgacttgcacatcttcaaaatgtttgctctttaggaaatgtatgcagaaataactgcctttccagtttgaattaggaacaaattggaaaggcagttactttgggggcacgggagtaagggtggtttgggtgaagggaagtaaacgcagtctggtaacactggtgcattgtatgcggcagtaagaaatgacaactccaaatgaggccggcttctctcttaatgtgatcagcttgctatgccctcaacgattccatgagattttgcattttataggttgagcttcccactggcagcaagtgaagcagttcattatgcacatctgtcacgtgatccacttcatcaaccaaatggaactgggagaataagtcaccctaacaagatccttcagtacactcttaaaaactacttacagatgtactcttcctctgtagggatacaatgggtttccttgtactgtgccacatgatacaggaaatgcattatccccatccaaattctggcataccaggaggaagcacgtgaaaagaaagcagctcacaaaagcacacaatgcttttgcaaaagtccttagagggactcatacaccaatttatgataacgacagataaaatcccaggcctctgaagctcagttcatttcaaatgctaatgtccacacagggaaaggaaaccacatcagcattcggcattgacacaaacattgttaatgctttttatttatggattgtcactgagtcccctcagcagtatgccagatttccatttgtgttgtaactttagctactttatgtgctttcatgactagctgtgttatgtacccataggcgattcatgctttcaaactgtgtctggtgagataagcggccacacttctgatcttgaatcaggaaccattttgttcacattcagatcaggtggaataaacgttttttagctaagcccaaaattagattcacctgccactgttaaatcttcctatttcattcacttaaccaacaaatattattggatgcctaccacgtgccaggcactgttccaggcactggagacataccgtgaacatacagaatcctaccatcatagagattacaatctagaggtggataaggggagatggtcaacaaataggcaatatgtcagaaagtgtgtcagtcaggataggctaggttattttgtggcaataacccaatatctcagtggcttaaaacaaccaagtttatttcttacttacactgcatgttcattgcaggtcagctgggggctctgctctgagagcaccttccctctgggacccaacctgcctagagaacccccatctagagtgtatggcttgtctttgtgggagatggagaagatagagtgataaattatatgccacttcttaaagcttatgcctgaaagtgacacatggcacttctataacatttcactggccaaaacaagtcacacaactacacccaactccaaaaggtgaggtagtgcaatcatatcatatgctcaagaaaatcagacacatttggtggacagaactgtccccgatgatgatgatttctatgaagaaaaaatcaaggtaaaggagacagtgtctgcgtaggaggtttctatttgacgtagatggtctggaaagttctctctaataaggtgatatttgaagagagattccaagggagagagagagagccatttggatggaggtgggggcaacttcctgtaaaggaaactgcaagagcaaagtgtacctggcatatttgaggaacagcaaggaagtcaaagtgcctagagtgcggtgagcagaagtgagcaaggggaaggctatagaaaatgaggtcagagtgttgtggaacacaaggtacagctttattgtaagggctatggccattgtaggtttttgtgtaaagacatgatatgagttagtttttaaaaggatcctgtggctgctgagtgggaagcatactcgagggtgaaggggtgaaacaaggggtaggtaagaggcttttcaataacccaagtcaggtaagaggaaagtagtggtcagattctggatatagtttgaaggtagagcaagagtatttgccaatgtattagatggtaggatgtaagagaaagggaggattcagcaatgacttcaaaggtttactttttctagtaatccttgaatatatgtaaggactacctcatgtggtcttggggaatcttcaaatttggcagtatcgctatagcatgtaaactcccctgtaaataagtggagttgaatagccaagtgcagatgtggattctgggcagttggcttgattcatgcaccagctaagggacttctatccccatactggcctcatatctagtctctcttagggtttatgattcaagttaatttataaaaccagagaaattagcctcataattataagcaaaataggagcttatgcctgggtcatcccaacttcactccatccttctatttctctgtgaacctcagatatcgctaccaggaaacccagctcctccagcatgagatctgtcctcagtagcatatcatatagtgatgtgtcacctccagttctcctggaaagaggttgaatagaaatcttaatacgtacaataaaacaatactgcggtgtttgtctgaatagtatgtccctctttctgcttaccctgccttcctgtaacatggctttccccatcaccattatccagtaaatagtaactagaactccctaccacacttagaccttctcttatatcttttctagcatagcagatcataggttgaatgtaaagtttgccaactatcataaaggaatgaataaaggtcaatgctgtttttaaaaactgtgttttgaggctgtttgtactcaaaagcattcatctactcaacaaacattcttgagttcctacgatgtgccagatacacatcttctagccaatggagtcacagctatgaatagaatatatatgtaatacatattattgccaaagactggaaaagcatggaaaagtataaagaaaagataaaatttctactaactcaccactgacacatagcagctagtaacattttagtgtctagactttttctaagcataatatccttcctccctgcttttttgaataaaatttataactctggacttacacattttttctttaaaattttttttcttattaaaaaaacagcagatgctcactattgattgaatgaatgaatgaattataggaacttaattacatagaaggaaaaaattttaaatggaaataaccactagtatcactataagagataacattgctgttagtagtttgggttgctcaatatggttttgaataattggaatatttgtacaactttgttccacaacaaatgatttactttaaaaataacaactttctcttttcccaaattacaaaagcaacatgccattgtggatattttggaaactactgaaaactacaaaaggggaatctaaaagtcatttatagtcccactgcccagaaactactgctattaacattttgggcatttttttccagtctttgttcttagcagtacaacaggctagttaagaatctggacaagctacttagcctctctgagcctcaaattccttatctgtagaatgaaactaataatgcctgccttgtaagattgttgtgaagtttaaatgagataaaatatacaaattgcttagtccagtatctgagccataataagtactcaatatggggactcttactattttgcaagatatttctacataagttaatcatactttatacataaacttttatcctctttaaaaaaaaaacattccatcattaatattttccaaaaacatttttaatgtctgcataaagtttattcatgtgactatactacagttctcgtaatgatactcccttcttattaaactttaaaaaaagtacattttgagacaatctcaatttttcagaaaagttgcaagtaaagtacaaagaccttcttttcccctgaaccatttgaaaggaagatgtcaatttgatttccccatcatccccaaatatcttagtatttcttcaacagagacattcccctacataactgcagtacaaacagcaaaattggaaaattaacattgatacattgcgatctaatcttcataccccagtcaagtttctccattgctcaataatgtataatttatagcaaaggattccagttcagaaccacacattgcaattatttgtcatctttccttagtcgcctttagtctgaaacagttcctcagtctttcctttactttcatatccttaacacttcaagaatatgggtcagtcattttgtagactatccctccatttgcttttctctgatgtattctcatgattaagttatatgtccttatcaagactaccacaaaattgatgccgtgggttcttattgtatccttagatggaacatctgctttggctatagcagcctgtgctgtgccattttcctatacagacacccacctcgccctacctgggctctaacgttccacatcaagccacccctcttcaacccacacttggttattcctttgcaagaaccactctcctcaccccatgtggaccctgaaaccccatgctggcctgcactcccacctttaacccacctggccccagtactctgcactgagccatcctctcagtcctctttggttctggcactctgagccaagctgaccctcttcagggacacccctttcatccttcttgggcacagtggctcatgcctgtaatctcagcactttggaaggctgaggcaggagggttgcttgaggctcagttcaagaccagcctggacaacagagcaaggtcctgtttctacaaaaaaaaaaaatacaaaaaaattatggctgggtgtggtggctcacgcctgtaatcccaacactttgggataataaggcaggaggatcccttacgtccgggagttagagaccagcctgagcaacatagtgagacccagtgatatggtttgtatttgtgtccccacgaaatctcatattgaattgtaatccccaatgttggaggaggggtctgatgggaagtgattggatcatgggggcagatttcccccttgctgttctcatgatagtgagttctcatgagatctggttatttaaaagtgtacagcacctcacccttcactcttttcctccttctccagcaaggtaagacatgcttgcttcctctttgccttctgccatgattgtaagttttccgaggcctcccaagccatgcttcctgtacagcctgtggaactgtgagtcaattaaacctcttttctttacaaattacccagtctcaggtagttctttctagcaatgcaagaacagactaatacacccagtctctacaaaaataataaaaaattagcagggtgtggtggtgcaggtctattgtcccagctactcggaaggctccaatgggaggatcctttgagtccaagaagttgaggctgcagtgagccgtgatcacgccactgtactcagcctgggcaacagagtgagaccctgtctcaaaaacagacaaacaaaaagtactatctactatctatgtatgtaataccagtttttcctcaaactggaggagtctgtggctataagcaacatcattgtgttttcattgtaagcaacatcatcgtgttttcatttcaacaatgttttaaaaacttatataaaaatgtataaacttatctggctcacctgagatgttcatttaaaaactgcatatttttagaattggtgctttgtgtttaaaattggattggcaccatgtgatcacttttgtgggaatattcaacttttaatgtgtccagtagtcattatgttggcatgtcctggcatcaaaatagcaataaccatcttgctttctgtttaaagagaatcattgagttaccttacctgttttaaagttaaaactgttctttttcagtgataagatgcaattgagtttagtctcttaatttatttaataaattgattttgattttccatcataaaaataaacatgctaatctgtcatacactaatgagaaaagaacagggctgatttagtacacaaatgatgcattcatgtaaagtgaaggccaagtgaatcatggtactcagcgcaaataaagttttactgtagttcaaacagagaaacatagtgagaaaattgaaatattacagggctcatgtagcataggctgaactcaaaagaagccaggcaaagcagtcactttatttggattataagcagtatattgggtttgattctgtgtttatgtgacacaccaacttacaaatactctccatgaagaacttttgttaaaagttcttttaaaattattgatcaggcgagacgcagtggctcatgcctgtaatcccagcactttgggaggcttaggcaggcagatcatctgaggtcaggagttcaagaccagcctggccaacatggtgaaaccctgtctctactaaaaatacaaaaattagctgggtatggtagcaggtgcctgtaatcccagctacttgggaggctgagggaggagaactgcttgaagcctggaggcgggggttgcggtgagcctagaccccgccattgcactccaacctgggcaacaagagcaaaactccgtctcaaaaaaaaaattaattaattaaaataaaataatttgtcaatattatattttggagaacgtcatttttaaattaagtgggccaattaaaacaatgaactgatggtttccaatgaataaccttgtaggagggaaaaattataataatgataatgattatgagtcaaatgactgtatcatgcttgataaatataagtcaaatatataagtcaacaattgaaataaaatctataaaagcatcatgttatacttttatcattatatgtataaattgtaattaaacccaatattagttatttagtttcagcaaatgttaccactttcacactgaattaatgtttttttatttgaatttaactgatgatttgttttcacttaatctgtaaatttgatttgttcttgtgattttttaaattgtggtaaaaagatatataataaaatttaccattaagatggtaaattattaagataatttaagtatatagttcagtagtgttaagtatattcacatagttgttcaacagatctctagaacggtttcttttgtgtttgtatagtttttagttagctacaagcataaaacatttatacctaattactacatatttgtacatatttaaggaactatataatgaaaattatttaagtcaacatggggaggggtttcaagagaacttttatcctttaaagaaaaagagatgtgagacacactaatcaatatggtggctctctttcagtctcagtgtttgctcaaccaaccctcttgacttttccttcttggctagctcacagagtgggctgtgttggagatgacagtgaaacctcatttcttggaaaagcagaatcagaggagaggatagcagtgttctacctgaattcaaatcttcctttttaataataagtataatatgaacacaatactgtctttcaagttactttttaaaatactttcaaatccattatcctatttttgaagccccattgtgaatctcttaagtaagtttcctttaaagtcaaacatcattggcagattttgatatgttatacctttaattattctagccagtgctgctaggagctttgctccttcgcaagatgttagaggaaagacatctcaaggtgctctgaatgttctgtgagtcagctgtggcctctcccaggccttattaagaaaataaactatgctgatgagctcccctgaaaaattagatggaggttttcagcttaaaactcatattgttgacctctcctaggctttctttttaaaatgaaagttttttttttgttgttaggatttgctgtttaactttttggaaataaggtaatagtcaaagtccccataatcattaactgtgggatagaaagcaagaaggaaagagcacgaaagaaaggaacatttaccgagtatttactagatgccagacagtattctagaagctttctattcttcatcttaccttattctaactatctccatgggagtcggttctgtcgtccccatatcattggctgaaattctgagaagtaaagtaatttgcgtaaggtcacccaacttgtaataagtaaactgaggttcaagcccacctttgtctggttccatagctacactgtgtgagtgagaaacgtgaaaacacctcacagactcagcttgggcagtgttttctgcaacagattttgtctggggaacttggacaatgccaatattcattcatagagtttctttgcccattccagcaaattatcattttctgctttctcgctcagttatttgtatacttagctgatggactcaacttcacacatttcccacaccctacttagcagagtacagaaatccatttgctctctcccagctggttccaacactggccacatctgcctttccagatgtgcgggctgcaatgtaaaacacacaaccttaccactccacttgctgcagtgttgtctggcccttcttgaggcatggttctaggctgctctttagaaaggtgtgatgtatgccctgtgggctgcattatcatctgttggtttaatatgcacattctgtggtgcttttacatacttttccaactttttacattctgtgtccatctctgattgcatttacatagtgatttatggagactttgaatattataatctaaagggtatatgtgggaaggaggaagtgagcaggtttgtttattaggaaaattcagcagtccctgcttctttaaagatctcaccttgaaattgcatcaatgtgagctcagtgagggtcggagaaaagggaccagctgacccacttccttatcatttactgtatgctgccttgggttgttaatggccttttcacatgttggtgttatatcaccccagctagattttaagtaattagagagcaagagcgtgtgtcactcatctttgtgccaagcatattaccttgcacacagtaggcatttaatgagtagttggagtctggttgctatgtgttagttgctgtgggtgctgctgaactctcaccttgcagcctttctggattagcttttgaatgacagttttattaggcatgatggaaccagacctcccatgctcacactgtggtgtcagggacttctgcctcatgtgtcttttcaaataataacattatgctggtacccaaagtatatggtaccagtttagagtcttgaattttaaaaacctgaatatggaaagaacctgctcaaccactttggaatgcccctgttaagctcaccttacagcatcagaagtggactccgcagccacctattagatccaatatgaaatgccctaaatactccccttacttggtgcctggaggacctcagtcttaagcttctcctttggactgagggcctgacaaggcctgtgtagggcaggctgagccaagccctggcttggattaggggtatcatccaggaatggaatgagcgaatggcttcaccttaaggaaaccttttaaatgagatgaacaatgaccttcttaaacaaaatagagaaaacatgatgtaaccttttccagatgattaaagatattgtttttaaaaccagtcacttgctgtgaaagctgtgatgttatcagtgacttctgaggggtgtttattgctatagtacatgatctgaaccaatgaagctggacattttaatgtggctgttttgatttgacctgggtgaaaattagaggtaagcttgcttttacaaacattacttagtgatttttttaaaagctgaatatttactagtgcttttcagggtgcttcaaaatattaatattttcatgacaaaaccaccttgtcaaaatgtcagctgtcatttccatcaagatgctggtcctctaacccttcttccctattgtcctgctaaactggcaacttctaacctaccaagcgttagaaaaacagaaaattgctcttgttagaaccatgtatataaagtaagagtaaatgtgatctgggtgagggtctgatggttgtgttaggaataagagtggggaggtttagtgcctaagccttgggatactgttttggcttggaggattatcccatgaaacccttttcaccactgatgccgtaggtggaattagctcttcaggcagacatttttttcttcttagggtcaaaggtaaggtgacatgtgaaggggcagccaaggcatcatcgggaggctagggcttgatggaaggggtaaggggggtggtgccgggcatctggttggagggaagtaggaacacaggcagaagcagagaagggcccttagtgctgccgagcacaggctgctgcttgacgcgcagccctcagctggctggccctggctggagaatttctccgcaggtcattggttttaccacagtcttgtttggaaaccatctgtgttctaggagcccatggagaacgggcatcttattttgaaaatcagtttgaagctaaagtggactttttaattacaaatgagagcaatgaaaatatagctattgaactttattgttattttggcctcgtaaaaattaaaagtaaacttttttaactcaagaggattttataaaatctccccatttgtgtacatttcagacatgagactctaccaccccagaacccatctgagaggaatttaaatctcaggaaagtagcagctttcttcaagtttctgagtaactgaaccttgtagataacaacagattggaagatagaatcagttaatccctgaactcaaggaacccttggcccatagcccagacaatacagcatgctgaaaattggtctggtcccagcctcacgtaaacctgtttctcctctcctgagaagaatgcagcttttgaccactgcccagtgtgagagcccggcctcactgttaacacctcagtgaaggcaagaacaagtggtttgcagtggagggcatcgcctggaaggtggcaaaggccaggcaggtacctgcggcccagctgctgctcgacgatgaggctggcagccaagtctagcgccagccttttcaaaagcagcccttttgataacactgattacatttccctcaccggagccttgggttaattgagcaacagccaacttctctgggtaacaaagaggaggggaaagtaatccaaacacaggttttattataaaaaccagggagtgagagaagtgtgtttattctgtaagataacacacctgctcggtgccggggaggctcatttccatcagttgccatggcaaactcgttatacttcaaggccatgtggctttgtttccttttgggatctggtccttgtcctaccttttctaacaactccaacacaatgacatggaagcctgcgacagcataattgatttctccttccctctatcaacggttcacatttgttcagcacaggactgagtctgccttctcctttgaactccttgctaagcatgaaggcatgcttcagagagccaccctcattaacattccaggtccctcttccctgtcagcaataaacaagccctgcatcaatggcctcctgccttccacttttacaaatgagtggctcagttccatgttttgctgctgatccaggtgcccaggcgcatacaacgcgagcctaagaagcacgcgggagggactaaaaatagaacagcagttttggatgcataccagagcagctacttcatctcaacttgctttgcacgctaagcctaatgggatccatcaggcatgagttctctcgcgcgctagctccctccctctcccctctctccccagctgccgatttccatcagccccttcctggtgaagggagcaaagggaggtcaggcaagggacaagaaatgtgtgcccttatggttttcgtttacaagccctgggagatctgggggctgcagttactccttccataagagagtttctagaaaaaaagcaggcaggcccagaacatggtcacctctgcccaggtacactttggtccaagactttcattgtttagcaaagcctcaaatatcacttcctaatcacccaatacctataacctggacccatgctcctatattccttgaaaagttaagtagaaaactaaagtacactgagtgttcctcttacagatcccacctgcttgcttgaggctaagaatttgggagcaaatgcacagtgagttggcaacatgtgactgccagggtctgcaaaagccacccacctgccgccaagtaccctatccaaaagtgatcctatcctaaagcattttccaatagaaaatggaagaagtcatatgcagttaggaacatgctatcctgcctgggcacaatacctcccagcatgccagctgtgttgactgagcgaggctcctttgtatgctaaagtgcctcgtgcagcctccctcaaaaggcgagccagcatgaccatacgtttctcatgtctacatccaaaaggtaatgcagatgttccaaacagctaagtattattccaagaagtgccatttttgtggaatcagaattgtgataggacgggctggacgcagtggctcatacccgtaatcccagcactttgggaggctgaggcgggcagatcacttgaggtcaggagttaggagttcgagaccagcctggccaatgtggtgaaatgcagtctatactaaaaacgcaaaaattagctgggcttgtggtgggtgcctgtagtcccagctactaggaaggctgaggcaggagaatcgtttgaacatgggaggcagaggctgcagtgagctgagatcatggcactattgtactccagcctgggcgatagagtgagactgtctcaaaaaaaaaaaaaaaaagaatggtgacaggaagatgaatatcacagtatttaaaaatctttttcattgttgatgttttggagattggccagatacaactaaaagaaactgatctgggccaggtgaggtggctcacgcctgcaatcctagtactttgggaaaccaaggtgggaggattgtttgagctaggggggtcaagacaagcctgggttgaacataatgagaccctgtctctacaaaaaaaaaaaaattttttttattttgagacgaagtcctgctctgttgcccaggctggagtgcagtagtgctatctctgctcactgcaacctccacctccctggctcaagcaattcccctgcctcagcctcccaagtagctggcattacaggcatgtgccaccatgcccagataattttttttgtatttttagtagagacgggatttcactggtctcaaactcctgacctcaggcaacctgcccaccctggcctcccaaagtgctgggattacaggtgtgagccactgtgcccagccaaaatttttaaaaaataaactgggcgtggtggcatgcacctttggtcctagctactcaggaggctgaggtggggggatcgcttgagcccgggaggttgaggcttcagtaagccgtgatcatgccactgcactccagcctgggtggcagagcaagaccatgtctctaaataaataaataaataagttgatctgactaatagcagattttgtctgtgtcaggcaagtgtcaagaccttttacattgtgcttcagtttcatataatagcagtataagataaatatgccaagccacttcaagaaaagtcatacttcatataatcacagcaataatcaattccccaaagaatttctaacggaacaagttgcaacatgatcatctaatcctccagtcactagaggatggaggtacttcttccctcagggagagggaagtatctcttcagggagacaccaggtcatttgttgaacacatctactgtgaaaaaccagaaagctttctagattcatcaaataaatgtctgcagtctggaaatcagaacatccgggttctagtcctaggatgaccttagacaagccacggctgctctgggccctgctttccttgtgtataaaacaaagctgcagggatatatgatttctagggtctctttctagactgaaagttccataacagaaataaatgatctgagaatttaattgattttcgtgctttctttcttcctttccccccgacctttggttgttgttgtttatttggttagtaggctaaaatagaactatttttcttgaaaaatagtgcataattctctgggatgagaggcatttcttctctgtggtattttcccacagtgtaaccttccttctcttttcatttgccactaggaggtgggtctcactgattcttcctggttcattaagaagaaacagaaagatcttgtgttttcagagactctttctggatcatttcccatgatcataggactttgcaatccatttggcaaaggtggtggtgacaatggggtgtttggcaaagtggatgaggtagttgacgaagcagctggggtaaagaaaaatgctcttggcaaaacatcatgaaactagggtggaatgttcaaaatggagaacttgcatcccttgctgagatgactccgagaaaaattctgtctttaaagaggtgatttatttaacaggaaacaaagaaaaaggtatcaacagtaataatttttctgagcactgagctgagaaatagctagtctaatactttgattgtagccatgtactgagacctctttgaacaatctagaagttaaaatagatttgaaaccagtcactaaaatttaaaattacatttaaaattctaaattagtcatcaaatattaggtaagaacctaaccttgcattccacaaacccacccctcaaatcggtgtaagtctgaataaagcctttgggctaagaggttatttttactaagtcagccctaccccacttccaccccaaaaatatctaaagatgaatgcctgaggaccagcataacatctaaatcaaccgagtgttaatcttattgtcagtgctctcaaatagttgttacaattcctttgatgggccgggcgtggtggctcatgcctgtaatcccagcaatttgggaggccgaggcggatggatcacgaggtcaggagatcaagaccatcctggctaacacggtgaaaccccgtctctactaaaaatacaaaaaattagccgggcatggtggcaggtgcctgtagtcacagctactcgagaggctgaggcaggagaatcgcttgaacccgggaggtggaggttgcagtgagctgtgattgcaccactgcactctagcctgggtgacagagcgagactacgtctcaaaaaaaaaaaaaaaaaaatgctttgatgttggtggtcatcggatctcatagaaatttcaggggccaagcttttgtcacttggccaagtgcgtgtgtgtgtgtatgtgtgcgtgtgtgtgtgtgtgtctgtgtgtactttttggtttgtttttttgctaccagtgctaccagctgtaacactttaatgactctttgtggaacaccagggaccactgctcatcaaccacctggggtaagaagagtggaaggaatgagtggttcagagcttaggacaggtctctgaagggaggaagggttaataacatcacattgctaagtctttgcaaactagaaacatttcagagtaattgctgatgtcattttatttacaaacgggtgtcgaatccttaatgatggtgtcacctcagactaaaaaagataatgaaaaaagagaaagaagacttgaagtttgtgtttgggtgttttccaggttatccaaatatgaaagtcagttctaccaggtctcaaaactacggaactaatgttacatgtcagaaagtcttacaaatgagtacttatgttatgctagtttttcttctcttttcctattttttaaagaacaaagacattcgtctcacccagtagacatctaagttataaagtaaatgaaactagtgttctttgcaatgcattagcaatgtttcttatttatagttgacaagtatttgtcctttccctgtgctacatataagagctggactgggctgggcgtggtggctcccatctgtaatcctagcactttgggaggccaaggcaggtgaatcacttgagcccaggaattcgagactagcctggacaacatggcaaaaccctgtctctacaaaaaatacaaaaattaaccaagcatgttggtgcacacctatagtccctgctacttgggaggctgaagtgtaagggtcacctgagcccggcaaggtcaaagctgcagtgagctgagactgtgtcactgtactgcagcctgggaaagagtgagaccctgtctcaaaaaaaagaaaaaaaaaacaaaacggtggactgtcttgtagcacaagtgagccttgtttaagaggctagtagataaagaagggaagcagtagcttgcagccccaaaaagtcttcattgtcttagtagcttgggccataattaaagccatcccacctttatagtttacgtagatttgatacatgtatacatattttatatatggatatgtgtatgtgttctttttctggagaccaggtaaacaagatatatagatacagatagatatccaaaattatcaacctgagggtattgttgaagtttttttttttttttttttttttgagacggagtctcactctattgcccaggctggagtgcagtggcgcaatctcggctcactgcaagctccgcctcccgggttgacaccattttcctgcctcagcctccccagtagctgggactacaggcgcctgccaccacgcccggctattttttttgtatttttagtagagatggagtttcaccgtgttagccaggatggtcttgatctcctgacctcatgatccgcctgcctcagcctcccaaagtgctgggattacaggcgtgagaagatattttttaaaagaggaaaatgttggctgggtgtggtggctcacacctgtaatcccagcactttgggaggccgaggtgggcggatcacaaggtcaggagttcgagaccagtctggccaatatgaaaccctgtctctactaaaaatacaaaaattagctgggcatggtggcaggcgcctataggtctagctacttgggaggttgaggcagaagaatcacttgaacccaggaggcgcaggttgcagtgagccaagattgcagcactgcactccagcctggacgacagagcgagactctgtctcaaacaaaaaaaaagaagaagaaaatgtctctgttaagaaaatgtaaatttgtcctctgagagacataattatgaaaatgaaaactcagtcactcctcaaaagagtatttagaatttaggtcctagacttcaaatcttttagagtgattagagatgcttttgtccatgtcattttataaatgagtccctggaatctaagaaaagttaaaggacttgctaaaggtcatacagctaattggtggtagaaccaaaattagaacacagactacaattctagcctacatcccccaacacttcatacacatatgcaaatatttttacctatgtagtcagatcctgagaaccataatcatactatttagaatcatggctgtatgctatataaagttgttttgttaaaaatgggtgtttttatttgtttgtttgttttttgagacggagtctcgctctgtctcccaagctagagtgcagtgacatgatctcggctcactgcaacctctgcctcccgggttcaagtgattctcctgcctcagcctcccgagtagctgggattacaggtgcacaccaccatgcccggctaacttttttgtaattttagcagagatggggtttcaccatgttggccaggctggtctcaaactcctgacctcaaatgatctgcctgccttagcttcccaaagtgctgggattacaggtgtgagtcactgcgcccagcctaaaaatctttattgcaagaataaagcttccatgattatggttaaaaagggttgtttaactagctggctttaatccattaatacagagtggtctgttatatttatctaatattatatctaagcagctttgttgatgtccctggaagcaactgcccatatcattataaattatatgtatctcctttgagataagtaaaacataatcttacaaaagagtaaacattttattatttgtacatgaatcagtttggtctgaggatacacaagcatctggctaactcataaaagtagcctgaagtgattgataggagagtgtttgtagtcatttccatttgctgccacatcccttacattatctacttgctaagcactgagaggcccagaatggacacatcaaactgtcaggaggaacatatgggacactggcacctgcaatggtttttttaaaagcagagaatgcagagcagtcacagactccacttcaaagccagggtgtgtggaggtctccggggaagagctctgcacaacaggtttcctgggggccagagggcctctcggggaggaacagaaaaaaaccagccaggagtgctaccgaccagcctcagccagaatgctgtcagaacaaggccccaaacatggcctggcctcagtgatctggggatgaacggtgtcacaagggaaccacctgaagggtgggcagaggcccccgtggaggagccacatactcttcctctctcagcagccgcagcaggatgttttttttattcttgggccagctgtagacatgagtgttctgaagccaggtgggcacatgctcctatgggaggcagaatgacaggagcaaaggtcattagagaaaaacctggatgccagatcccaggctcagttcccaaacatttctggctttccctacatgggcgtttcctaccaaactatcctgggagttgtgctgttttgcttttggaaaggtttagcatgtgaaatgttcttggcttcgggtacaagctgtatatctcattataaaaaccacatgtgcacagcattttctgtcagtctcccagactacctaccctttgcatttcaacttgcttttcaccaccctcacataaaaggggtaggacagaggtcacacagagtgatgtgaattcccctgtgacttcagaagaagtatgccagggccgtaggcttaaatcaattcattactctttcactccagccccaggtctggcctgcagtagaaggagcccatcagacctcagtgatcaggcagaggcagaaactgttagccagggatcctgggggtgcagtgtcagactgccctcatggagtggatgttctggtggggagaggcagataataagtaaatggatagtgtgttcaacagtgatgtatgctgtggagaagaattaaacaagaaaggggacagggagtgctggggcaagggtgaaagatttgcagttttaaacggggtgcttaggagaggtctcactgagaaaatgagcaaagacctaaaagagtggaagaagcaagctctgtggttgtctgggtccaggcagataggagagtcagtgcgaaggccctgtggagggagtgtgttgggtctgttcacaagcaacaaggccactgtgagtagagcagagtgagtaggtgcagaggtctggaagtagaaggggctgtatcggatagtgccctgtaggccaccataaggcctttgcttttgagtctaactcctagggactataggacgggacttctctaggtattgtgcttagaagcagcacctgctgcatggcaggcatcatactgagtactgaggatgcccaaatgaaaaggacgcagggactgccttgaggacttcaaatcttaggatgaaagcaaaatgtcaacaaatgattttctagtcaatggtgtaccaaggggacaggtggtgagagcggcctgtgctgggctcaggtaatacgggcattgtctgaaggagatttaaaaataataacaaaaccaatgaaaatttggtctattttgtatatcgccatgctccaataattctcaacaattattcccagtaccctcaacccaaacacataccattgacccaaggtgctagaattaagcacccttaagaaagggacaatgaaatatatcagcatgaaggtaaagaggtgtcagggcagggcgcagtggctcacgcctgtaatcccagcactggggaggctgaggagagtggattacctgaggtcaggagttcaagaccagcctggccaacatggtgaaaccctgtctctactaaacatacaaaaattagctgggcgtggtggcgagcacctataaccccagctacttgggaggctgaggcaggagaattgcttgaacctgggaggtggaggttgcagtgagctgagattgcaccactgcactccagcctgggcaacagagcaagaccctgtctcaaaaaaaaaaaacactttgggaggcccaggcaggtggatcacgaggtcaagagaacaagaccatcctggccaacatggtgaaaccccatctccactaaaaatacaaaaattagctgggcatagtagcacatgcctgtagtcccagatagtcgggaggctgaggcaggagaatcgcttgaaccctggaggcagaggttgcagtgagccgagatcacaccactacactccagcctgatgacagagcaagactccgtctcaaaacaaacaaccaaaagaggtgtcggggaggctagagagattgggtgatataagggtaagtaagagttcactaggcaggcaagttagggaagggcattgcaagcagacggaacagaaaaggcaaaggcacagagacaaaagaacacagcatgtgtgagggcatgctgaaatggtccagggtgaccagagcacacagcatctacagagggtgatgagagaaaactacgcaaggggacacagtcctcttctgagaggcctcatagatcgtgctaagaaaggtggatatgatcttgtagtcaatgggaaaacggcacaaaatttgtaagctaccaagaaacagatcagacctacattttggatgttcctctttgatggcagaggagaggatggctagcacaaggtcaaagtggagatgagaccagtaaggagactcatcagtaagtgacagcagtgagaccctgggcaaaggcagcgcagggaggatagaaaggtgtgccatcgcacaggctgtgcaccatacagcctgaggtgtcccgttcccataaactggagcctccctcatccagggcaggggtctcagtgcagtcttgacatctgaggatccctccagggtgaaacagggcctgagtttagggtgctgtggtctgattctcaacatgtttactccaccactgccttccctttgccaagcatggaatgtggcctcaggtggttttgcccccattctccaaacttgctggcagacccttctggtgtgaaaagcctcatatgaatcacggcaaagttcactcaggtaactatagatttaattcctgtaatcattagctttgagagctgaactatgtgcaatgaaatgcctccctggaacagccagcaaaaaccatacacatcttgacttttatgtacaagagataagaagtatgacatgaaccttctctttttctttcttgagttaaaacagaaactacatctttgtgtgcaacggttctttgaacaattaggacagcagtgatcctatcagatagctttaaaaccctcctgattcatactgctgaactgagtggtacaacttgttgatctttctggtaacattgttatctctaaggattgataaagaattgatggcagacatggtggttcatatctgtaatcccagcactttgggaggctgaggcaggcagatcacctgaggtcaggagttcaagaccagcctggccaacatggtgaaaccccatctctactaaaaataaaaaaaattagccaggcttggtggcagggacctgtaatcccagctacttgggaagctgaagcaggagaatcacttgaacccaggaggcagaggttgcagtgagccaaggtcacgccattgcactccaggctgggcaaacagcgagactccatctcaaaaaaaaaaaaaaagaaaagaaagaaaaaaagaatggacaaggttttccatttaaaatcccagatggcaaagcaaaccaaagattgaattatgaggattttgtttctttgtttgtttaccttcttagcatttgggaagagcacagggatgaatctgaaattcatgcttccttgttttatgaactcaatctgcatctgaaaccaaacaaatgtgaaggtttaatttcaggaatgaggatgaggagttaatggtacccataatcatgcacgtccacatggcatttttattctgatttccatacttgagtgccacacacttaacattttaaggcctccccattacacatctattccattcactcatcagtcgtttattggaggcctgttagaagtcacattctatgtcagactttgggttttaaggattaggataccttccagggtatgctggaactggcttgcagcagctcacaaaagcttgttgtgtgcatctcttcctaattctgtgttcagtgacttcacactgatagcttgaaattggcgatggtattggagagtatttataccatggaaataggtaagtgctacaaatcaggagagccagcttagcagaacaccacagatacagtccctatcttcacaaagccagcagtctagtgagcaggcagaaagggaaattaccaaccagagtgccgggtgaaaagtattaacaattgctctagaagcccagaatgggggccatccattctacatcagagattggaaggacagttacaaaagagggttcatttgggcactgaaagaaaagattttggtcaagtagggaaaacagaggcagaggcaacagcatgagcaaatgtctggaggtgtgaaagtgtgttgatgtggttgggaccagctactaatgcactgtgactagagcacaagatgggcttggcagagaggggatgtcaattgcgaagagctccatctgccaggctttaggttcctcacaccagttccaatatgctctgacactgtggtagcccaagaagatttagctaccaagaactctctcaaaaatcagaattttcaataggaggggagttagagtcttccaaatcctgtgaccagcacaaagctttcagtcatctgatgagaaggagacgaggaattatgtgtttccaaccatttcatcttccaattcatttttataactgagaagttttcattgtgcatggaaataacagaacagagaagaaagtgacagtggtgatagctggttattgaaatcaccatagaaacccctcataaacacacactctcacatagttgcatacgcacacacacacacacacgatcacacaacacacacaaatcctccacaaggtgttttttcggaaccacctctctctaaaaaccataagataacaccaagaacatattttaaaatgacccaagtactgtgcagctagaagcacccaccacaccagcaccgagtacacatgaaaggaaggggatggggtgcataagttacaagtgaagcactgagttttgtttgacttctaggactccgtatactgtgaagtttggcttgtgcactaggctgcccagcctgtggaggggccagccagcagcagtgcatttttattttctctcacccttccagaaactgagtttctgtaaactaattcactgtatgatgcagttactcatcagtacctctgcactacctctgtcatggccaagttcttgttgttccagggttttctgttgcctagaggggtgcaggaagtcagccaggcagtcaggaaggcacttctgtgtctgacctcttcgaccccttctatgatgagtaagggcccaagacattgtggcccaagaaaccaagtttggcgacagtttggttccagttggtacagtcagacaagctctgaggccaagctgtgtattactgcctggctacaccacacacccacagagctagacaggtttccttaggaactggctgaggcctcgagcccttcccacgcaccagctgtcagcttctgggactggcaggttcctagagatgcagacaggacattgggtgctctgaggccatgcagacatgcatcagacaaccaagggccggcagcaccccgagccagccatgaccttttcaggcagtttactcccaggaatgatacctttccggggcactgtacaagggctgtgagactggttgagaccagaagaggagggagccttatctcctgactccctggcctcactttttaacctcatcaccttgcctcggctcttccttcagtttggttgtgagctcacgtgagtggtctgcacttggtggaaagggagacagagaccatgaagactcagatggggaatacccaccctcctactttcccacgctgctgacccacaggacagacctgggacctacatctgcttcccctgaggtaaagctgtgtgccccgagacagcctgactgtgccctccccatcttcccatcttagtgacactctatgcccattccaggtgccttccccctcatgaagtgttagagctgaaatggagcttatcagttctagtccagtgattttccaagcctttttaaatctcagaatccttggtcaacaaacaagcctgagaagtacagaccagctctggctgaggtaggggtgggaggcgcagacccagcccctcctccagcacatatgggcacccactgggaactccacaggacagcctgaaagtcacaagtgtagcaccgcctcctagtcaagcagaaactgtctcacagcgtctctataatcacggggagaaggaggattcgtagcccataaaacagccagttccaacgctgggtgattgtttcggtcagaatgttctagttttatcccatgctggacaagtttaatatcctaaatgtctcccacttatttgaatataaccaggccccatagttccccacctgtcatgagctaagaacactcccttcccttgtttgagcatctgatatgcaccagatattttgaaaacattatttcatttcatcttcacgacaatcctgtaagtattagtgacccattttgtgaatagggacattgaggcacaaagagtttaagcagtggggccacggtcacacagcctgtacatgaggaagccaactttaaccaggcccacatgatgcaacagcaggtgtccctttcactacgccacctgcctttctgaaaaggtagggcacagaacatgatacagctgcaggggccagccctcctcaccaccccgtctcctgcctcctaggacttcatagttgctggtaaacagccaagccagcagagcacgtctttccagaatcttggatcctagagatgacagattgctctccccttgcaactgataggaacaactgagtcccagaggtgcagggacttgcccacagtccctaaggtagatggagccagaaccaacagctcctctcctgacatggcaagcctggagctcttcacccagcatcatgctgccttcagctggtctctggggaagaatgggacttccctggacaaggtatccatccccaggggacagtgaggtgttgtgatcccctccccactcaccattcgatgaatgtacttagtatgtaagccatgctcatcctcgtccagctgcgactcagcgccttccacgtcctgtttgtatttggggctgattgctacgattatcatcacggtcttctgttaatgagagggagaaaggcatgtttatggaagtgtaccagcaggactgtgggcattctctgacacacggggtggagggccaggctcattctccatagaaagagaagcactggcccccactcaggcagactcttatctctgcttctcccttctgtctccagcccagccccaccttgaacatgcagagcaaatggctcagagaggggctctctcaaatagatgtgcttttgcctaccattttccacaaccatcactaataaacctctaatgaaagcccgaatcactgagtgagtctgtgtcgtggcaaaaaggcactgcaacaccaacagtaagaagcaccctccctccctccagctggttctgagctgccagtcactgcactcgactgccctgtcttctgcgtgtacacattagcacagtcagtaggaacagacccttcagcacaaagcaaacatcaggctgcagacaaaaggaaaagtgcaacaccccagcctgctgagactcccgtcccccactggctccctccaaaagaagcagccgacacggacacgctggcagcaatcaatttcgatcttgttaaagcacaacgtgtcccagtggccggtatagattctgtcagtggagaacaaatcacggggctgcacgtgggcacctcgggggtggtgtgctgtgcagcctgcgaggctgcctaggaaacctcttcagcccaattctacaaaacacttggggtggcctcagattaaattgaattctgctgctctctccccactctccgccttcatttccttctttcctattctcgtcaaaagattgtttcctctgattgttatcaaccacctgtgtctggtttgaccgttatttcctgcctgtgcatgtccaagagggcgactccgtccttcctttccaagtctttgcacggcttccaacaagggaggctttgttggggctttctcagcttcagacttaggtgggtatgccagggtttctttaataaaacaacttcataagctcattgtctttctcaccagaaaacaaactctggtttttggaatgtacttacatccctaaggtagcgctccatccatttaatgatatcaatgcctcggattctatcctcaaatatgtcaatctgcaaaaaaaaagatgtgggagttggcccttaatgagaggttctctcaagatgcagagcagaagaaaacacaatactatatacatttaaagctccaaaacttaactaatgctttttgcaagaaggagcacataggtctaaaaaacaaaatataattttctgaaaatattccctatttcaacattagtaggcatttaagtagttaatgttatgtccataattaggatattgtgatacacatcaaaatatatctatggctacacaataatcaggtttttaaaaatctgagggacacggtataccactaagttggatataagccagcaatatacatatattatatatctgtaatttagacatttgaaaggcaaacataattctggaacattttaatggatgtgtggcatacaagtaactgagatacaattgtggtgctttacttgcattagtgaggtcattattatggtattatgtacagtttcaatctatatgtttcaaaaggattgtatgaaacttggagcagagccaaggaacagtcacaaaaacaattactgaaacggtagggaagaggtttatgatgaaagtcagaagtagaactcttaggccttgaaaagactgatatttactatcagcattcaagtttttgaagggatattttaaaaggagaaagatcagttattttttattttataagaaaccaaataagaaggcccttcttgggctcaggcttatactgcagagtgtgtgtgtgtgtgtgtgtgtgtgtgtgtgtgtgtgtgtgtgtgtgtgtgtgtgtgtacgtgcacgtgtgtgtttacgagatgctcttgatgggaagagggattatatactggaatgggtgactcagggagagtgtccctggggaggggttacgtgattcagctgcactgctcccagattacttgtcctaaatgtcattccaggccaggcacgatggctcatgcctataatcccagcacttgggaggccgtggcaggcagatcacttgaaaagccatccatgatccatccatgatccagcctcgccatccatgatccagcctcgcctctcttttcctcacatatcctgtctactttactccccacattggagtcccctgtaccctaaaggcacagcacaaacccccctgctctgtgaatccttcccacatgccaatctcctcctcttcctcacttcacctaactctaccccattgtgaccactaatgatactggacaattaacacgtatgataacattcttttattcaggacatgtttcatttatgtctgctgtgtctcttcaacctgatgctaagcctcctacggaaagagaccatgccctgtgtataccgaactatcacatacatagagtacagagttcagaatatgtgtctttacatgaaaaatggaatggctgttattttggtttagatgactcctgttttcaaatgtgtgatggccaacgactactcttgagaacgcttttgtagctttctgagactgtgtcactaatccattgctattatatgggagagaagcaatatagtgtcagggttgagaagaaacggacagcttgggttctgtcttggctttgccacttcccacctgcatgactttggaaatgttactaaaactctctaaatcttatcttcacttgtaatatgtagttaataaactgacttcctacggtggttgtgagaactaaaatgagttaacatggaaaaggcctatcataatgccaggcaggaaataagcactcagtaaatggtgataattggccgggcgtggtggctcacgcctgtaatcccagcactttgggaggctgaggggggcagatcacttgaggttaggagtgtgagaccagcctggcaaacatggtgaaaacccgtctctactaaaaatacaaaaaaaaattagctgagcttggtggcaggtgcctgtaatcccagttactcaggaggctcaggcaggaaaattgcttgagcctgggaggcagaggttgcagtgagccgagatcgtgccactgcaccctagcctgggcaacagagcaagaccccgtctcaaaaaaaattaaataaataaaaaatagtgattattgttattatccaagcactctaaattattcccagctactgtagtggacatcctgggtggtgcaatgagctggatatcttccatttgtttctccaagtctctcccaaagtccatagctcctgttatgatcattcctccacacagctactattatgggctgaattgtgttcccaaaattcctatgttgaagccctatctccctaccctacctcagaatgtgactgtatttggagacaggacctttaaagaagtaattaggataaaaagaggtgatatgtatgggccctaatccaacagaactggtgtccatagaagacgagattagaacacagacgtgtccacacagaggagagaccatgtgaggacagaaggagaagacagcctcaggatgaaatgaaccctgctgaaaccttgatcttggacttccagactccagaactgtgagaaaataaatttctacgcttaagccacccaatcggtagtactttataggaatcctagcaaactaatatagccatcctcttcatcttccagtaagaattccttctttgactctttagacctaggggcagtaacaactccctgcttttgctagtgccagaatactgcactatccccaataaaattggactctctaaaacctacccaaagctttgtaataggccccttattacactctccttaaattactcattaagtgtttcattccactaaggggatctagatgtgtcaataataacttagctgtccaggaccgggctctgtgatttctaccacaagtcttcatagagatgagggtcagggacagatttaaattctgcctatgtggcccctggttgtgaagataaacaaacaaaacctaagctctcctccaggggcaatcagtatgtgtctttggaaatgacaaaaagtaagatcttttctgaaatgctggccttatgtcttagtatttatttatattacagacctggtcttgttatattgcccaggctggcctccaactcctgggctcaagtgatcctcccacctctgcctcccaagtagctgggactacaggcacgcaccaccacacccagtgtaatttgattttatgtcacagttgccacagtgctttctttttttcttttttttggagacagagtcttgctctgttgcccaggctggattggagtgcagtggtgtgatgccggcttactacaacttccacctcccaggttcaagcaattcttgtgcctcagcctcccaagtagctgggactacaggcgcacaccaccatgccaacttttttttctttttttttttttttgagacagagccttgctctgtcacccaggctggagtgcagtggcgagatctcggctcactgcaaccttcacctccagggttcaagcaattctcctgcctcagcctcccaagtagctgggactacagaaatgtgccaccacactcggctaatttttttgtattttttgtagagatagggtttcactatgttgtccaggctggtcttgaactcctgacctcaggtgatctgcccgcctcagccttacagagtgctggtattacaggtgtgagccactgcgcctggccatagtttgtattttagtcgtgatggggtttccccatgttgcctaggctcgtcccgaactcctgagctcaggcaatttgtctgccttggcctcccaaagtgctaggattacaggcatgagccaccacgcctggctgctatagtgctttcttataccagaaatgagaaagggaaatattagtctctatataattatggagttggattgtataagttgtatgcattttttaaaaaagaactttcattttcattttttagaaaattgtcttggccgagtgcagtgactcacacctgtaatcccagcactttgggaggccaaggttggcagatcatgaggtcaggagttcgagaccagcctggccaacatagtgaaaccccatctctactaaaaatacacacacaaaaaaattagctgggcatggtggtgggcacctgtaatcctagctacttgagaggctgaacctaggaggcagaggttgcagtgagccaagatcacaccactgcacaccagcccaggcaacagttctagactctgtctcaaaaaaaaaaaaaaaattatcttatagaataaagaaagcttcaaataaaaactcctgttaaacaatactaaataacttttaaaattgatatttagttactaagtatccctctttacccatagacatttatattcatagatatttcccttaatttttcaccactctctagaattcactagaaaaggcctagaagagggctctggaaaggaaaagaagttatctcagtgtttgaggaaagccagtcccctgagtagcatcatgtggtactttatttatcatagagaaaaatttacatggctttaagctgtactgtgtcaagggactgcagggggacaggggcagtgtgtgtttcctgagatttctggagccaagatcacagtgggcttgcagggctgggtgaggtcagcctcccctggaactggattagaccagccccaaacctggccagtatcacccatccagaagcatcactgcgtcaaggtatgaaaatggcagctgtgcgcaatgggggattcaggctgcaggattctacttcaaacctcataacccagtgcagaacaaaaggtccttgttaaataagcaggtgaccatggtgaagcctgcagcttcctgcatcatgggaaactcagacaaagtgggcatgattggtgagaaaggacaaaggtacaaagtgcagcaagagcccggcgtttccttcaggccaggggccgctgcatatgtggtcagcattagcactgatcttgctgttcagaggtacttggggtcactcaaacagcatacaggaaaaaaatgctggagacttcagatagcttaaaatctagaaaattattacctaaatctataagcattcaatgcataatcacataaatcaaataatatcatttaaaacaccaacagctattacactttttcttctgctgcttttctctccattgtactcactataactgttcagttatctatttggacaaaatacttactgcagtttggaagccatttaccaacaaaaagttcacgaatttcaccacctccatagctgtgtccatcgaataagtgataaagactttccctaagagaaaatttttacatttattagaaactgatcaaattattctattgtaaacaaacttctaaattatatgcaatatcttttgtccttctagaataataagaggaaaccttgggcttggggtgctctaagagcttatgcctacgttgtatgctgtcctcagggcacagctcctcaggcccaaaatgccagtgggtctgtccaagggagtgcagactgctcagcgtgaatggaaatcagagcgacagaggagagcactggcaggctcagacaagcctaaggaaatccaccacccagaatccgcgagcccttaagatcaggcatgactagtttcttagagacacttggcactgtgcccaaggaatactctcccagcaggcaaagaagctaaaacttgctaagggaccacccagcagtgtcttcttttgatctcctgatgctctctgctgccctgaaatctcgctcttctgacaatagcaagtgggaggagagtgagaaactggttccccgctcccttcttccccgcaatccactcacttttgcagaaaggccagcaagtttggagtagaccaaagcacagctcagatatgttagtaaaaaaacacttcagcagcttgaagaagagacactgcctctgggcagtccaacatcacagactccatcactcatccctgggtcagcttagagcagcagacagtacagtttggataagctttacccagtcaggatgaaccagtgttttctcaggctaaagtcttggggaaattgtctgactagcattttaatgtgaaagctgaataattactttgtgttggcttttagtctggaatggaccacttaaatctcaggaagcccttggggcagaagatggagaagaaaggggggctggagagaaaatacgagtctgtatctacactgaggttttttgaaacacacctcccaaatggaagtgtgtataatggtcatattaactcacttaagcagccagatatatagatggcactcaattttcttctgaacacctaacattcacccaattgttacgtatttgaggacttcctttatagattatggtaagatatatatgatctatagattgatatcaggactataatgtatgtggggcagcatctgttctccagaaatgctcaaaattaaaatgattaagatcttaagaaagtgttcagaaataaaatgttttgaatgaaaacagcaatgaatcattgtcatagagagctttcagagttgtcaatgactaaacagcacagatcccccaaaaggaattagcagatgcaaaaggctttgtttcaggtttggttcaaagaggttcccagatttggaaaatgcatattagaattacctgagcttctctagcaagcacatcatataataatttcacaagtagtggctgttttcttaagatttctggaaattactgtcctgactgaccttaatatgagaacattttggtgatatttcaacatttctggttctggcagcaaaatgtggaaaaagaatcatcaccttacgcttagttgaatgtttctttaaataaaaggcttagtttgcatttggttgtgatgcagtatggagaatgtgagaccgttttttccaaacaagattgctcattcctacaggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagaggtaagcagtttttgagtgttactagtggtgtcagaatcactaaaaacattcatacaaaatgctggttactttttaagcaaaaagcaaaaaagtgcattttattttactgtgtacatgagaaatagctgaggttatgaggccaggtacagtggctcacgcctgtaatcctagcactttgggaggccaaggcgggtggatcactcgaatccagcagtttgagaccagcctgggcaacatggcaaaaccccgtctctagtaaaagtataagcaaattagctggttgtggtggtatgcacctgtaaccccagctatttgggaggctgaggtgggagaatcacctgaccccaggaggttgaggctgcagttagccatgatcacaccaccgcactcccgcctaggcaacaggagtgagaccctgtcttaaaaaaaaggaaaatcttcgagattagggacgagtgatcatccagccatcacaaagtataagacctcacaagaagaaggagtggccgggtgcggtggctcacatctgtaatcccagcactgtgggaggccgaggcaggtggatcacgaggtgaagagatcgagaccatcctggccaacatggggaaaccccgtctctactaaaaatacaaaaaattagctgggtgtggtagtgggcacctgtagtcccagctactcgggaggctgaggcaggagaatggggtgaacctgggaggcggagcttgcagtgagctgagatcgcaccactgcactccagcctgggcaacagagcgagactccgtctcaaaaaaaaaaaaaaaaaaaaagaggaaggagagaacaatgttgcaaacaacttacgcaattcttctggcaaattgcttgtttttagagttcctctggctggagggttgctagggggtctaggcacagcagctggggacggaggctggggaacctgtggtctcagctctgcagggcactccaaggactccccaggagcaccagctctattaggtggctggtgatgtggctggtccctagaaaggaatacatttacagtcaattttcattctttacaaaggcaaaccttcagggacagaaagacttttagaactatgggaagatcccagtgggctctctctcctctgcctctatttcttaactgagacagaaggaagaggggagctccatggagttgtagtcaataagcgtttcagctggctgccacatgtgagggcctgtgctctgactccaaagagggaagcaggatttgatttctctattcaagatttgtttaattggaaaaacaagtctcatgcacagggcagacaaggtcaccaacaaaacaaagtagtatgacaggtgacacagatggttgatgttataggcattcagataaaaagacatgacttttagctcataataggtaacatttaattatgtatcaaaaggtaaagagggccatgtagatttagaagtatttgtactgttgacatataaatggaaatctgattttgaagaccctttaaagaagttgctaccatattagatagcatctttattattttcgttgccagtattcccacgagcattctgctgagatgaacaatcagatgacctcgtgtgagatttggaggagagaaggaaatggagagcatgcgtctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccgccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaattttaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttgcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgtgttttgtttgttttttagtttttgagacagagtctcactctgtcacccaggctggagtgcagtggcacaatcacggctcactgcagccatgacctcttgtgctcaggcagttctcctgcctcagcctccttagtagctggaaccacaggtatgtgccaccacacccggctaatttttgtatttttttgtagagatgggttttcgctatgttgcccaggctggtctcaaattcctgggctcaaacaatccacccacctctgcctcccaaagtgctgggattacaggtgtgagccaccaagcccagcctagctcctctacctgaacttatttttcattatcctaaagtgataaaatagatcaagaagatcagaacaggcttaaattgatgctataaaaccaattactctgtattatctttgcaactcttttgtaagtctaaaattgtttgaaaataaaagtttattttaaaaattactattctctttcctattcaacacaaaacttatttcataaagatgcttacattttgtttatttccctggaattttagatatttcttctgttagagtgcctatcctgctataaaatcacattttacctaattccattgtttaaactccatgtatttatggtttagaaaaataagggatctggcccagcacggtggctaacacccgtaatcccagcactttgggaggctgatgtgggtggatcacttgaggccaggagtttgaaaccagcctgggcaacaaagtgagaccccttctctgcaaaaaataaaaaaattagctgggtgtggtagcgggcgtctgtagttccagctactcttgggaggctgaggttggaagatggcttgagtgcaggaggcgaaggtttcagtgagtcgagatctcgccactgcactccaccctaagtgacagagtcagatcctgtcccaaaagaaagagagaaaaaaagagatctgtcttgaaagaaaatatgagggtttgtgggcttctgagcaaaagagaaagcaggcatgtgcctcttcaccattgttaataaagtgggctttttttctttccatgaaatgttcaaactaattaccgctttctgtatttctgaaaaatccactctaataggaacttcatattttactctatgctgtaaaaacagaatctagttttacagtggtatataaaagttgcttttgagcaaaagtaaacatttaatctactttcttccaaatattgtcataaatgaggaagctccatttacatgagttttacctatatattttagatccataaattaagagaaaaggaaagtccaaagagaataagggaaaaaaaatgattaaagaggcagggcacagtggctcatgcctgcaatcccagcactttgggaggccgaggcgggcagatcacaaggtcatgagttcgagactagcctggcctatatggtgaaaccccgtgtctactaaaaatacaaaaattagctagacgtgatggcgcgcagctacccaggaggctaaggcaggagaatagcttgaacccaggaggcggaggttgcagtgagccaagatcataccactgcactccagcctggacgacagagcaaggctccatctcaaaaaaaaaaaaaaaaaaaaaaaagattgaagagttagacaactgaagtcatgaaaatacggagttaagcataggagagacctaataatggtactcaacatgtatgaatgtttttattacaaaagaaaataataggccaggcacagtggctcatgcctgtaataccagcactttggaaggccaaggtgggtggatcacttgagcccaggagttcaagaccagctgggcaacatagggagatcccttcactacaaaatatacaaaagttagctgggcatggtggcgcatgcttctagtcccagctacttaggaggctgaggtgggaggatcgcttgaacctgtaaggtagaggttgcagtgagtcaagtttgcaccactgcactccagcctgggtgacagagcaaaaccctgtctcaaaaaaagaaaagaacaggtaattttaaattttgatggaaaattaattgaatttaacattttaaagtaagaaataggcttaaacaggaacagacactagacatataaagagttggctaacagtggaagtcagtcgtagtaaaatcaaaaatctattttgtggactaaaaattcagatgatctgaaaataaaagaaaggggtgtgacttggagaacatctgaagagcctttccttcaagagaatttcgactagtcactagtggctttctatgtctgataaagagatccttgtcaaccagcttccgtttcctcctgacctgaaaagtctatattgggcattccactatgtgacttgctcactaacgtgggttagcaaacctatagagaattctgttacatcttcattgcattggcataattcctttccatgttaaaaatgcctgaaggttgggcctgtcatacttactggtgccttggaagccccggaaaggagcagtctctctgtgcgggcctctcttcgtggtcccaggggctgggataattcaggataaccttctgcacagggtgcaggcctctcacactggctccaggcaggggctgcccaggcagagccggctggatcacttgctggtaggctgctcgagggtagtcatggccatctgtaggtgaagacaacaaagacaacagggaacatcaactctagctccttcgtgtgaaaggagtcataagctccatgctcatttgtgtcttgatcccagctgaggggtccagatatctgttaccacctctgtgatgtttgccgtatttctctactgttaattacttgagtgttttcacgaaattcacttttttttgtcctaaataaaaacatctgcgaaatcaccagtttggtattccagctggagagctcaaaaaacttttcaaaaaactctacacaggctcctcttttcgtaagatacttaggaaaatccaaccatgaagaacctctttcacaccaccattcctaccacaatttccttcatgtcccgaacccaaggctaggaaaaattatctgtatgatagatatagaatcactgctctgtattttcctcccccaagtggacatacacgtgcatgtgcacacacacgtgcgcgcacacacacaccccactctcctcttaagaagaggtaaatgaatgaaaacttggctcatcctcctgggaactagccaaccaactggcaataccctccaactcccttggtcctctcctgctacagcctacgtgcacttggagccagggctgcttgaagagggctgggctcagagcaaagccagagctggcagtgacttatgtgaatgtgcaacctgggagaaagtgggtcccagccaggaccaggagcaggagggtccccagggaagggcagcctgctgctgccagagttaagcataggagagacctaatgcttaatcacgcaaaagaatagaactaaaagcccagaggagagatgcagggaaccaagtaagggtgagagggaagggctctgagggaatggcccaggcccaaagggggtaaggtgttgggaaatacgagagatgcaagaggactgaagtgagccacatggtagccctgcaagatgagcaatgagcacctcctagtgatccaagcactgcccctcctacccacataagcagtaagacgatccaggaggaggcgtaactagttaggacaagaaggaaggtgttttgttttgttttttaaaaatcctcattgatcttaaaattattttgattcttttaagatcaaccctcattgatcttaaaattattttgctgattataaatgtaataatcaagtttgcctgccatgtagataggatacatatatggatgtacagcaaaataaaactggcaagtaaacaaaaaagtgactgataggttgaaaccaaaatgagaagctgagaatgtggataaaaattgattcttaaggccaggcgtggtggctcacacctgtaatcccagcactttgggtggccgaggcagacagatcacctgagttcaggagttcgagaccagcctggccaacatggtaaaaccccatctctactacaaatacaaaaattagctgggtgtgatggcgcgcacctgtaaccccagctactcaggaagctgaggcaggagaaacccttgaacttgggaggcagaggctgcagtgagctgagattgtgccattgaactccagcctgggcaacagggcaagactccgtctcaaaaacaaaaaaaagaactgtattcttagcttggcaaagcagtcaggagccatctacgttttcaaaggaacattcaggggaatgatggcctcaagtacagaacaagagataaataatgtgcacgttcactagtgtggcctcctccaggttcccagtgcctagactcaggaaactgtttgggtgacctggcgatgtgcccaagctagtctctcaagtgtggtcagattccctggactcaatctattattgtctcctttgacccatgtcaccacctgggtccttccagtcatgcttcttctggcaaaagtgaccatgcccctccatcccagactgtctcctggcaggaccccatgacccttgccctgatattgcttaggcctggtcatgacaagtagtaggggtttaaagagggggaggaggagaaacagatctgcctagatctatccctgcacctggatgacaaaggagactgggacttgaagggactgttctcagaatggaagacaggcccacagagactcctatggtctaggacaaggtctactgcacaggcttcaccttggcagccttctcagggcagggcggatatattccagggggtccagatcaccagttgcagtttcagggcaacagagcaagtcactactgctcctttccctcagtttaaaaaatagcaaaaaatgccactgctatcaggtccccaggtaggggccagccctgcttttcaatgagccttgcatgagcagaccctttacaaacccagctgtagctagaaccgtcttggtggactgcacttacaatccaccctgctagatcaggttcccgcccctgtagatcttgcctcccactacactctcactggcccactaagctctggcttcattttgaatatcccaaacttgtcctctcctttgggatcctgagtttgccaccctctttgtccagaatgtttttgccctagattttcacagactgacttcttgccattcagagctcagcccaaatatcacctgtccaaagagtcctgcctcttcacccagttactttatcccattccctattttgctttcttcgtagttcctatcatgggtttgcataagtaagcatgacttttacctgtcaacttcttgcctgccttccctactagaatataagctctgtgaaagcatggactgtgtcctcttaccaccatgtctccaaggatagtactggcacccaggggatgctcaatagatgaatgaatgaaggctcaatagttacaaagccgacttacagaaaaagagaagccatttaggactgcacaatctattaatactttctagggcacaggtctcctagaccaggggcccccaactcccaggccacaggctggtatcagtccattgcctgttaggaaccaggccacacagtaggaggtaaacagtgggtgagtaagtgaagctctgtctgtatttacaaccactccccatcacttgcattaccgcctgagctctgcctcctgtcagatcagcagcagattctcacaggagtgcaaaccctattgtgaactgcgcacatgagggatctaggctgcacgctccttatgagaatccaaggcctgatgatctgtcactgtcttccatcacccccagatctagctgcaggaaaacaagctcagggctcccactgattctacattataatgagttgtataattatttcattatatattacaatgtaacaataatagaaataaagtgcacaataaatgtaatgcacttgaatcatccccaaaccatccccatccccagtccatggaaaaattgtcttccatgaaactggtccctagtgccaaaaaagttggggaccactgccctagactgtcttaattctcttctgctgtccatttgttttgggggttttttggtttaatcggtgtctccctccagaagtaggaaggagaaacacaaggtaaaagaggagaaactttgccagtggccttaaaagcctttatgaggaaaaagctgaaagtatcttgagaagtttttaatgtttgaagccatttttcttcctatatccattaatgaatggctaatattgttttatttgctttaaaaggactaccaagctctaatcatagggtttatttcttttccagaaagcggatgttggtgctgttaatcaaaagcctttgaatcaaggtcatatgatttctaacagattatttccctcacaacatgtctttgtctcacagcaacaaatcatatcattaaaatcaccaaggcatgtgggctaagtgtttgattagctgtaactttcatttcagaaacggccacctgtggtaaaaagttatgccagtttatgtgagcagatgaaaatgatacacctcatcaatttttaaaattagggtactgacaatatagtcctccatgctgtccttttattgttgaaaacaaaggaaaactgagtatcagtggatcagtaagaaatgagtgttcccttttgtaagtggaatctgaccagctttgtctggaatttgactggttgtatggaaaaggttcctaaataggctggacacgcctgtaatcctagcactttgggaggcctaggtgggtggatctcttgagcccaggagtttaagaccagcctgagcaacaaggtgaaatcccatctctacaaaaaaataccaaaaaaaaaaaagaaacaagaaaagttgctaaataaaaactatgtttatcaagtaaatgaccatctttttcactgctaaagttttaatcatttttttccaattactatgacgaaggcttgccaatttacttgggtactatacatgtaaaataatggctaacatttattgatcacttgctacatgtcaagtactgttctaagttccatactgagaattatagagttcaattttccattttcataaagaagtttaactcagaataaaaatccagattcctcaccatggcccatccagccttcatcttctagcacaccattctctccttgctcactctgctaggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggccaaaaaaaaaaaaaatggcttttccaaggcttcacattacaaagactctactcatgattaaggctcactcctttccccaggaagtagagaacagatttctttttattcattcaacaaatatttattgaacctcgatggccaggcacttggtgaacaaagataaataggatacagttcccttgggattagctcaaaataaatggagaagagaaagagaaaatctatgtgtctgtgggtgtctgtttttaaacacaaacccacactagttagtgtgtgagaaggggagacatatgagtcgacagccacctacttgagaatccctgttcagaaatagcttccctgcggacttgtccccaatgcctacagttccatcaagagagttaattctgtaggagagggaaggtggatgatgtgatagacaaatgatttgctagcatggtaactcctcagttcagaggcagtgttaatcacaaagcaaaaatgaaaatcttgcacaatcacaaatgggcgcccaggactgtatgttatttgtcaatcctgtgatcttcttggcctgagtacacacgatcttcatgttactgagcttttaccatttggaatatgtaaaccaaatcctaaatgaggttttccatttatcagtcacaacatgcaacatttttcttccttattaagaatggtattaaaagagtttatgagagagaaataaaatctgattttcaagttgtcaaaaaaaatcgtgatataatgcaatcagtttagccaggaaacaaaatggccaatataaactgttgcaggaactcccacagctgtaagcagctgtcgttcctgaaaggcaactccttctttatcatttcttccatctggtttattttttgtgcatgcattctagcatacaaataatccctccccttttttttttttggtccacaggtacaattgtacacatgtacctgtaattttattctattcagtctccttggtagagaaagcaataattttataataaaatgagggctctctagacttaattctctctcttttcccaatatatttgcatcatgagtttcatttgattgcacagccatgaactccatgctggcgaccttcagtggaaggattcggaggcagcaggaggccgacttctccagggggtggggtgaggagaaaacgtagacttattccctttcttatttccacctactttgaaaactttttttttttacatgaaaggggcgaccaataaccatttttgctttaacttgcaaaaagcttagatatgccatttgcatggtgatcattatttatttatatattcattaatgggtaaggaagtaatgctcttctaaagctgagtagagccacgtagccatggtttccaactgcacaagcatcccttaggtgaacagctcttttgaagtggttttgttagcaattaagtgcagttatagccctgacatgaaactaagcatttgtacacctgccatgaatgcttaaaatctgtgccagtgagtgggatctggaagtagaggagcaccctgcagaactgggctacaggatgcttttaaataataacaataataactaaaagctgttagtattgagggcttaccaccagccagccactttcctagtgcctttaatacattatctcatttaatcctcacagcaaccttcgtgggactcattgctgctggaggcctcataaatattctagggctacaatgccctgcaaaaaagccatcagcactggcaaccctgaccctcttctctgtggttagatgggagccagggccaagggacatgcaaggtgaattggggcgagcttgccttctatacgtgctgtttccctttgttcttttcagtttttactcatttcttaattatagaagtaatacctgtttgctatttttatttttatgttttctatgtgtttttgtttttgtttttaagactgagtctcattctgttgaccaggctggagtgcagtggcgcgatctcagctcactgcaacctccaccttccgggttcaagtgattctcatgcctcagcctccccgagtagctgggattacaggtgcccaccaccatggctggctaatttttgtatttttagtagaaaacatttcaccatattggccaggctggtcttgaactcctgacctcaagtgatctgccctcctctgcctcccaaggtgttgggattacaggtgtgagccactgcacccggccgtttgctatttttaaaaatcaacaaaagtatatgaaattagaaggaaaatatacctgtctcctcttaattccctgctcccctccccaccaagatcaccactagatccttctagacttaatatgtatatataaacatatatagtttttaaaaaataaacatggatgggatcatcactgcagctcttgcctttcaacttaatctttttgatgtcagaatgtgtattcagtgcaacatgggcctagtagtccatagtatacataaatcacaaatgacttatctggccccttattgataggcattgtaattgtttttgtttttactctaatgcaacaatgctttaataaacattcttgttcttgtatttgtatatgcttgtttaatgtttctataggacagattcctataagtgaaactgctgggccaaagaggaagcacatataaaactgtgatagtgaaattgccttctgggagattgcaccaatttacactcctatcaagagtgattgggaatattcatttctctctaactccactaacactggatgttgtccaaagtttttatttttgcacaactaatcaaggaaaaggtatctttaagaattttgcacttcttaaatctaatgatattgagcttggtttaattttcatattggctatttgtgtatcttctgtgaattattcccctctcctatccccattctctcccctctgcctttcaacacctcttttcgccccaaggatcctagatgtctctccccaaccccctaacagaaggaaataatacagagagcaaggggatggtgaaatgatgaaagaaagcaggtcctggggcaatagggacaaaaagtgttcccagtcaggagtgtttgccttttaaaggagcctgccccaatgggacaacgctcacctccaaagactggattgccaatggcgccgtttcagctccaacaacaggaaaagtattttccgtgggaagtattttccagaaggtcctgggaccttcattataacattgagtcagtgctttttttgtctatcacaatgaggctttcccttgttagtagtcagagtcagctgcttgggactgtatcacaaagccttaagtattcacagttcttcgcattaatctaaggagttaatcggaagtgcagttaaaaacatatgtatgcaatgcttgccatagcattgcttattggatcagaaaactggaaactattttaaatgtccaacaataaagaataggttcataacaatttggtagatgcgtctgatgaaatacaatgaagcagttttaaatgattctggaataagtactcaatgtcactgaaaactattttaattttagattaaaaatatatgcaaagaaaaaaacactgaaaattgatatgtcaaaaccctaataaggaattctatttgggtggcagaaatatgaaaactttttcttttcttttttgaacttctgggcatattttaattttgggagtgaccaaatattataatgatcagaaaaattatcttttttttttttttttttttgagatggagtctcactgtgtcatcgcccaggtgcagtctcggctcactgtaacctctgcctcccaggttcaggcaattcttgtgcctcagtctcccgagtagctgggattacaggcgcccgccacaacaactggctaattctttttgtatttttagcagagacagtgtttcaccatgttggccaggctagtctcaaacttctgatctcaagtgatccacccaccttggcctcccaaagtgctgggattacaaagtggggtgagccaccgtgcctggtgaaaacttacctttaaatacagataacagaatgtccaaaagtagtttatggtattattctcacaaattactccttttaaacctggcaatcactgagaaatacagccttgaccttgccaacattcagttctcagtgattcatacttaagggaatccaccaccacacccaccctatgactgggcgcttagagcaggggtggcatccatgcactcccactctgttgacttcccagcatttatacaccacgtcccagttttaggcatcagaggctctttctcccgctccagcccaaggccccattctccttacaccctcctgcttccccagcccctgccctcattcctgatctcacactcattcttacctatttcttccaagcatcttctaagttacatttctctatctcctctttgtttttttcttttttgagttatgaattactgtgttgctctcttcactttaggaagctttatacttagtatacatgtactaatatgtaaattatggttgattacagcatttgtaattatttctataatttattttaaagctgcgcatcaggcctttggtcaggcacttcttacactctgaactactttctgtccagtgtttatttgctaagaaaaatatcaggcctcacagccctgtgtttcatctgtaaagcccttttgttattttccagtggcctcagcggagatttaacatcaagaatggtagtaggaaaaaaaaaatggtgatagaaccttttatctcaacctaagacttatcactttcagagatgcttcctgcactgatacatattattatttcggaagtagtttattgagagtctagtatgtgccagacactgtgcttaaatcctggggaattatgaattgaaagtacacgtttgcatttgcagatgcacaaaaacttgcagtctagaaggagaggagacacgtacataattagatgccatgctggtgttaggtgtcccaacagggccagagcaggagggagacagaggccctgaaggagaacgtgatctggggaggtttccagagggacacttgagctaagtctcaaaaaatgtgtatgatggtggttgcataactctgtaaatatactaaaacttattgaattttttatttaaaatgggttaagggtaaaccttgcagtatgtatattagatctcgataaagcagtttttttaaaaggtgtattgaaactgggtcaaacacaccagaaggggaagaacatccccaagagagagaagagcctggcaaacgcatggagatgtgaaccatcgcgacaagtagggggactgccagtcttagagtggctggaatgtagggtagctgtggatggctcaagtgtccaaaaggatttaagcagcaaaatcacagaaacaacttcattttcatgtaatggcccgaatcccagagtctcaatgacattctgggcaccttctggttttttgttttgttttgctttgtttttgactaaaagccctttctctgccaagtctaagatggggaagaaagatgacgagaaggaagaacccatatgcccaaagattagaacaaaaaatacattttctagaaatcattttggtcatctctctgcttctaggcaggtttgttaaactaacccagacagaggaacccattttgtccttaaaggtccctagagaaggagactccaagtgggacaggctttaggctaagaaaaagcattctctgcaggccctttgcaaatccagccacacatggaaagcccctaagagaagcagaatgccctccctgcattctgacctgttcatgccagcctagtgacacgaagcattgatgtgaggcccttgtttcttcagtcacccagcccagaatgcccagaggaggtaaagatcacttacatggcacctggtgatcgggacttccaggacaatggtaatgatagttccatggagcatgtggggaaagattgggaggcagcatctgtgcacatgctggatacctctgaggttcaaactgagggaactccctggacctgagaggtctggggaggtcctgggggtaacacacggaggtgaggggcaggggcctttccagctgcctgatgcccaggacatcctggggctgggaatcatatcccgtgtctatggttggcagatccaggcctgctcggttcctgtgaggctggggccgttgcaccatctcctggctaccgcccaaggagtctgctgaggcattaggtaaactttggtctgatttgtctgagtcatggccagtgtcaggagaagccgctgaaagctgagataccagccattgattacgtttttccataaatgaaaactgatgctctgcagggagggctccaaccacagactcagacgcaggctcgctgactgcagagcacccagaagggaaagctttgcccaggcctgggtgtctcctgcagaaactgtcttcactgtcctccagaacttgagtgcgcaggcaggtgacctgccgggatacaggccgctggtgatttgcaagtttcagggttgagtgagcttgagaaaagtctccggaggaattgtgaagcattgtgggtgcagacaagctgttgggtgccatgttccttatatttggagcaggtggttctgattcctcttccggggaatattctgggattggtttcagcaactgacttgggtatggttctgattcatcaacctccacaggaatgcttcggttcattctagtttctggaacaagagaaaacatgctatagccttagaagacagataaattcttggagtcctcactttatgaccttaagggacctcattcaagatgtggtttaaattaacagtgagacaccaatgtgcttgcaaagccctaatcacataaaattgtttacttatcctccaggcaaaagcactaatgtttattaagatattttatctggaaggcaattcaaagaatgtgattggaccatcctgtggtagaaatcattcaccagcaaggggaaaacacagatgaaaatcaactgccaagtattgaggaaagagaaattatcataatgtgggctgcttcgtgtgtgcttggaatacatgaagaaataaatcttagtaactgatatggaatgatctctaagatatattgagttttttttaaaagccaggcgcagagcagtgtgcatactatgctgctattttgtgtaaaaaacgagaggagaatgtgtgtttctgtgtgcatatctgcttgtatatgtataaaccgtgtggaggatatacagacattgctacactggttgcctttgaggatggaattaagctgggggagaggagtgggaggaagttttcaccttttaaacttttataattttgttccatttgactatttcctaattttaaaaaataaaagtgttttttttttaagcaaagaaagcaagcccaagtttaaaacacattgaaaaaaggtcagagtgacattttctacctaattttaggtcatttggaggacttaattccctctgggcactatgcctgcaacaaaggtagccatgaccatctggtttgtgatgtagttgaaccagcaaggctcgctaaactagaccttagcctgcagagcatttatccaacgggccgggcaatattgcttttagctgtaagaagaactcttaattcacctaacacaatgagaaagaaaaccagcctcctctcatcattaaactgattgagatgatgccttgactgcaggggcaggaagaacgcagtccagaggactgcacaggagcaactgggggtttgcaggaggctgcagagcaggtgtcgtaaaagagcaagcaagtgaaaaagaagaaatcccagagggttattctatgcaaggctagtacacagcatacttcaaataccagagagagaaaagggattatgtctggatttaaaaattcctactttggatccatgtcgcatttcaaccacattcactgagggctcactgtgcctaaagtcagtttacataaattatgttctaaaacaagtttcggagagcatgaattcactttctcttgcaccttgtacccaatccaatgggatcaggacagcatgcattttgaaatgctcccctttcacacagatggggccagcagttttccaccaaatatgcttaacagcctacagaaagatacctctccactccctgccaaatgaatgctctttgacagtcttctcccacttggtatcaaacttacccacctgctgcacaacgacccttgctctgttttctgacacaacagaaaactcaacttctaatttccggctggccttccctcctccctccgtctctccctttccctatccttgtccttttcaggctgtgtatgtcctctgctcattggctctgcagaaaaggagacctcatcagctaaagtgatcagaccttataaaaatgaacaagagcctacccaaaaaacctgtaaataaatattgcaactttttattatttaaaaaatgtttggccgggcgcagtggctcgggcctgtaatcccagcactttgggaggctgaggcgggtggatcacctgaggtcaggtattcgagactagcctggctaacatggcaaaaccccctttctactagaagtacaaaaattagctgggcgtggtggcatgtgcctgtaatcccagctactcaggaggctgaggcaggagaatcgcttgaacctgggaggtggaggttgcagtgagctgagattgcgccactgcattccagcctcagcgacaagagcgagactccatctccaaaaaaaaaaaaaaaaaaaatgctcaccattttttccctttctttcttgcaatttttccacagttatgaaattggatgtgccacacaacatgctcttcagccggtcagaaaacgaaaatattttttcaaggcctggctgactgttgtgtcatcgtctacatgcacttgtgggcacacagctgaatgggaggcaaagagatgcaaaaagtgagctgagtggcaggaggactaattgctgtcctctctttattgccatgggatttgctttcaatcctcactcttcaggtacaactatttccattctcactgggttttccagtgtgagtaccttagaagcgcttttctacctaaagaaaaaaaaagttgcaaattctactcttctagctgaggagccatctgggggcttggaggaggctttaaaaaaagtgatgagggcagtcatctcacataaactggaaatctgaggtcatcctctggtgggaattcttcagttaaaactgctctggggctgggcgtggtggctcacacctgtaaccccagcactttgcaggctgaggcaggaggattacttgaccccaagagttcaagaccagccttggcaatataatgagaccctgtctctacaaaaaattaaacaaattagccaggtgcggtggcgtgagcctgtagtcccagctacttgggaggctgaggtgagaggtcacttgagccctggaggtgtccagcctgcagtgagccgagatcgtgccatggcactccagcctgagtgacagagcaagaacctgtctcaaaaaataaaaataattttttaaaaaactggtctggccaggcgcggtggctaatgcctatagtcccaacactttggaaggccaaggtgggtggatcacctgaggtcaggagttcaagactagcctggccaacatggtgaaaccctgtctctactaaaagtacaaaaattagctgggtatggtggcaggcacctgtaaccccggctacttgggagactgaggctgaagaatcgattaagcctgggaggcggaggttgcagtgagctgagatcacacctgttgtaccccagcctgggcaacaggagcgaaactctgtctcaaaagaaaataaaataaactggtctgaaaaggaacacatggcttttgagtatttagtaaataaacctggcatggcaagaaacaacttctaataaaactatggaattaataatctttaaaaaacaaaatggaccctggtgtttcaaacatgtcactatcaaatactcaaaacagcagataattacagaactcaactatgtgtccaactcaatgctgtgtatcccccttctgattataagcccaactgaaatagttttattactttttaaataaccacaagtgatacaaacttcaagaggtaccaaagggtatgcatgccgggcgccgtgactcacgctgtaatcccagcactttgggaggccaaggcgggcagatcgcaaagtcaggagttcgagaccagcctggccaacatggtgaaaccccgcctctactaaaaatacaaaaattagccgggcatgatggcaggcacctgtaatcccagctactccagaggctgaggcaggagaattgcttgaacccgggaggcggaggttgcggtgagccgagatcgtgccactgcactccagcctgggtgacacagcgagactctgtctcaaaaaaaaaaaaaaaaggaggtatgcagtgagagataatcacagtaatttctgaagacacagaaaacattcttcctaccttcaagttgctgtgatccagcctaagagaggaaactaagtaacatgcagaaaacccacgaccggcgtcccagggccttcgtgcttgtcgctccctcttcatggaacacccttcccccacacagctgcatggctggcttcctttctccttcaggtctttccttggctgtcacctcagggaggtctccctggtcgcactccctaaaatgtttacactctcctctcattcccatctcccttccctgctttaccttcttatccagcagttattactgtcttatatattacccaaatgtatatgatatacacaaatatctaataatctcttatttgctcattgcctctcccttctcccagaatataaacttcctaagggtgcaattttctcttttctttttctttgtgatacgggggtcttgctctgtcacccaggctggagagcagtacctagatcatggttcactgcagcctcaaactcctgggctcaagtgatcctcccacctcagtctcccaagtagctaggactacaggcgcacgccatcatgcctaatttttctgttttttctgagacggagtcttgctctgtcacccaggttggagtgcagtggcacaatctcggctcactgcaacctctgcctcccgggttcaagcgattctcatgcctcagcctcccgagtagctgtgattacaggtgtgcgccactgcgtctggctaatttttgtatttttagtagagacagggtttcaccacgttggccagactggtctcaaactcctgacctcaggtgatccgcccgcttcggcctcccaaagtgctgggattacaggtgtgagccactgagccagtcggtgtgcctgacttttaaaatttttttgtagagatgaggtctcactatgctacccaaactggtattgaactctttacctcaagcagtcctcccacctcagcctcccaaagtgctgggattataagtgagccaccacgcctggcctgggggcatgatttttgactgttctgtttacagctatattctcaacacctagaactgcacctggcacatagtaggtgctcaataaagattcactgaatgaataaatagttgatgcctatttcagagaggggacagacaggtccatgtagccggatcagtgacaatgagaatgttgtcaacaacaatgttgggtagcaaggagtatctggtgggcctggtcctcagagttcttaaaattatgccacgtgggtgacccttccctcttctttttttttcctctccagaacatttattaagtgcccactatgtgtcaagcacccaagttaggtctgggccatgcccaaaggtcctgcccatgggcaggattgaccacaacccttacttgcagaataaaggtgatgccatcagccagtgtaatgggagcatctgctcttagattccaggcagggagttgctggtctttgtgcctctgcagagctccacctagaactgaaaagggtggggcacgcctgccactaccacacaggccccctccagccccagacccctgtctgaactggcagaaagtgggcaaccctgccaactctcctgaggcagtcatagagaacaattacaaatgccacatcagggggccacagacagattaatgggttatgtcaaggatggcagttttatctgttttgtctttaatgtcaatagtgtaaaaatactaaacattaaaaagcaatcactcagtatctcaccattgtatttttaaaatacaaaaaaaaccattcagcagagggtgagagcatgtaccctgggtaagcacgagtgggcatgaactggggacagaggtgagtcctggggacatataactggatggaacagctgtgcatgtgagcctggttcttgcttgtgctgacccaacccatttttctgtttttcctttttttttccaggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccgatacagagcccaggccccacacccagagcctctgagtatttttgtttattgtatgtaaaatactagtgtatttttgtttaagtctcacaggtaaacaggttctctcatactttgccaagggaaatgtaatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcaaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaatttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaagctttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaccagcccatgtttttttttttttttctgtcgttgtcattgttttggtttttgtttttttgtttcttcagataagatggtttctctaagcacatgtgtgatccctaattcagccacagccacggagtgaaggagaggaaggggtagaaaggaaaaaccaagagaggaagaggaagggagagaaaggaaggaaggagaacggaagagaagtaaggaaagtggggaaacgctgaaggatttttttgtatttgccttttattggtgtaggagagacacttatttacttgtaatttgtatgtagtgctgggtatgagaaggggcagttggaagagaagggaaagaatgaatataggtgaaaggtaagagtgtcatagggtaagctgggaggccaggaagagtttggacagacagctcagagtaggaagagagttcagagcggggagggagacctgttgactctgggaaggggaaagggaaaaaacactggcatcctgactgcagggaaacaatgaggcagcggagagcaagtatccctcattgctgagggagctgccaagaccccaggcagcctcagtctgtggggtgcggcctgtggggtgcgaggagaggggcacaggctgggagctccggtcagtcctggccctcctaaagggcttgagttcagctgccttatcagggaaccaagccaaaccagcacagacctaaggatcaccccatggatggaagcccacccttcttcagccagtctacaactcctggtatccgggaaggtctgtgcacacacaaggtgtgcacacacacacacacacacacacacacaaggcgtgcacacacagctacagagtgagctgagtagtcacagccaagcacatgtgtgcttctaggaggcctgctgggcacgggaggcaaagaccataagtgggagaaaggacagcctgagtttcatgaactaaaaatatcttggtgacaacgcattgggaagaaacaggagaggcccggggggcagcttcttgattccagtcctcagacactttctcatggaaaaatccttcagactgcaggattgttttgataaggaaatgtgatcaaacattaggggtcatttcattggatctgaaaggaatttaaagttgaatatgcctcatctgtgttcactcttttttttctgcagcagttgcctgcaattcatatatgtttttagaagctaatttaaaattgcctgcagaagaaaaatgatttgaattcaggatattcctgagatttccattctacaatgtgtaaaacaaagatttcatttagacaaactaccccaccataatctttctgaatgcctgttgaagaatgcctgcagatatgactgtcttctcctcttctttttcttttcagagcatttgaaagtcactaactccttaatcccgggagaagcaggctttaacatttcctgtctctacaccttccaaaaatgagtaaccctgagttaagaacctttctatccgacatgttggtacattactcagacctcacttctgtttaacccaccccatgcaaggaacagagcagagtaactacattatccatcttttgatgctccatcatggagtgactggtagctgcagcagcagattaagaatgactgtggtgtgtggcctttaaggattagagcgaggctggcaagtgcacaacagttagcctgctttcagataatggtgcatcgttgtttgaaaataaaatcaggaactcattgcaggtgaaatatcttgaaattcctgtcctttcatcccaggggaatagagagaaatgcctaaaaacatgacacggactacaccaggacatcccacagaaaccaaaagtcctgcaccagcccatcccagtcagctagggcctgtttgaactgtattgatggcaagtaattgccaaaaagaaacaatgacaatttttttttaagtcacggtctggaaaaagttaaggattctgtgtatccgccatctaataatgtctctaatcacagtcatcacccttacatggtattaggatgtgtttcatagtttcccttcccctcccattaaaggccccacacacagtgactggtccagctgaggagtggtttccaggtccagctacagcagtaactctggcttctggagctgggcttgtctgccagttctctggcctgccttgactctgtggacaatagcacagactatccttcctgggtaacccaaatgggacatgaactaattcgagaaactccctgttttctcctatttggctagagccagtaataaggcctcaattccaggcagccctcccgcagagacacgtgtctcccagcctttcgccctgactgctgctttacctcttgccttgagagcagacgagtgaaacagaaatcaaagcagttgacatggaaggggggtgagcacctactaggcatttggtagcatgctggattctgggaggtagaaaaatatcaggaaacaaagtcctttcctcaagggggtaaccaactggtagtgggaggtaaaattaaaatatgtgaataatcggtaaacaaaacaagtcttgaagaccacccattaccactacccctctgggactatcctggctttgttttataagggaatttgacacactcatgttagatcaccaccccccatcaatttactgatgaagaaatccaggcttagtggagtcagagtgaattgcctaagtcatggaaccacaagaagtgaagaacttgaaaccaagtttcttgtccttttaaaaaatttggcctcttgttctcctgttcctttaaaaaaaaaaaatccccctattctaagataccatcttgaacttgaaagtcacaagaagcttgattagcttctaagatcaagttctggcatttctcccccttgttcccaaaggctccgtccagcgccaggctgggagggctggagggcggctgcggagaggggccgggaggcggctcacagccagcacagagctcagcagaacttcctggcccaaaaatgtgctgttgatttttttcccccctgcacgaaacaaggattgagaaaactgccactgacgtgttctggggctgaaagccaattacttaatctttgccatccctggctctctctttggagaagtggggcttgaattcttgagagaaacttgtggggacactaagtacccaaacgaatggttcccaggcagctccgagctgtccccgtgtgcgagcctcctctcctcaaagggttaacccggcggggctcgctggcctgaaatactatactagcaacacatccttgcagcacaaacttcactgtcattttctcagctaagatggtctctgtgcgaacaagttaaaggaggggagacgaacacagaggaaagtagaggcagaatgtttcagtaaaggagaaacagcgtgctttgggaaataggtcagaggtgaagaaataagaccaggcaagtggcaactccgaataacttaccttagatccaccacggacagacagactgggcccggagggtagtcggctctcggcggcttctcgtctccctccaccttctccgggcccaggtaagtagaagaacaggctctgaagcaggaagtggaagctgtatgcaaatttctacggagcctaggaagcctctgctcaaaatctccctgtgggcagtgaatcaacggctgaggagtcactttatttcttaaaacagaaacctccttcattcatgagaaagggccagtgaccaattaggcggcatttttgttttcgccacccagctaagaagctgcccaggagtgggcagaacctcagtgtagtcgcagtgccctcgcctgggagggtgtctccgggaggagattgaactcgaatgttaagaattagtaatcattagcagctccaaaggaggggattgtgggcagataatggggaagaagagggagtcgagcttcttccacctcctctaactgcttaaaacatcagcattgccgggcgcggtgactcacgcctgtaatcccagcactttaggaggccgaggcgggaggatcacgaggtcaggagatcgagaccatcctggctaacaaggtgaaaccccgtctctactaaaaaatacaaaaattagccgggcgtagtggcggacgcctgtagtcccagctactcgggaggctgaggcaggagaatggcgtgaacccgggaggtggagcttgcagtgagccgagatcgccactgcactccagactgggcgacagagcgaagactccgtctcaaaaaaaaaatttaaaaaaacccaaaaaatcagtatttgctgcccataaccactgggggggggggggggctcactgaccatgctcctggacacacgtgtacacacagcatacacatgcctgtggcttgtgcacacacaccaccctattgtcaggcacaaaaaaagtggttaattttaagaacacacacacacacatacatacacatgcacacatgcacactaacctcctctggctgcattttcctgacctcaagattttttttctcccctttccttcccattgtttaatcagtagcctgcagaatttattgcatgaaggagcgctgcaggcaggatgatacccagcgatgtgaacagagagagagagagacaactgcctttcggggcagcagtcagtaatgggagcagtgttagctggagctttggagtcaggaggacctgggtacgaactcagccatgtcactggccagctgggcgccctgggcagacacaccatgctcctggtgctggacttgtctgcctgttgaaggggtccaagtgtcagtccactcagccggctatctctctactctcatcaaggggacaggccccagagcatccctgttcagattgtaccaggttctgctcaagcaggatacaggaagcaggttgctcaacattccacaagcagagaaaatgcagcttgtttttaacacagtatacacaggttgtttgcatttggtttgcagaaaatgatgcagctattaaaaatcatcaatatgtatgtattatctgagccactaacatgaaaaagtggctctgagatattatttaactaaaagtattatcttattttttgccaatatatgtgacatatacacacacatagatatgtatatcgattttttttaagagacagtgtctcagtctattgcccaggctggagtgcagtggcgcaatcatagctcactgcagccttgacctcctgggctcaaacaatcctcctgcctcagtctcccgggtaggtgggactacaggtgcacaccgccacacctagctaatttttaaattttttctagagacaggtctccctgtgttgctgaggctggtcttgaactcctggtctcaagggatcctcccaccttgtgagcagcaagccacccaggtgccgaggcaagagactgaggacacgagctgttccagtacaataaaatataaaacaagaatagttataccagatatagatcttagatatgattatatatgaatatcattaatcattagtttgtagcaattactctttattccaatattacaataaaccttgctctataatcataacctaggaaaaaccaggccatacgagataagagctgaggggacacagtgagaagtgaccaaaagacaagagtgcgagccttccgttatgcccagacagagccaccagaagggctccttggcctagcggcgatgccagcatctgggaagacgcctgttgccaggcggaccgtggtctagtggtagcgaaaagcgtcaaggaacaacacccgctacttagcagacggggaaaggggttcccgggggagtttagaaaagactgcccctccacctcttgtggagggcctgacagcagtcagccttgcccacagttatccggaggcctaaccgtctccctgtgatgctgtgcttcagtggtcacgctcctagtccgccttcatgttccatcctgtacagctggctctgccttctagatagcagtagtaaattagtgaaagtactaaaagtctctgatctacaaaaataatggcataaactgtctttctctttgtctcctctctctctctgccttggctgccaggcagggaaggttcccctgtccagtggacacgtgacccacgtgaccttacctatcattggagatgactcacactctttaccctgccccttttgctttgtatccaataaataacagcgcagccagacattcggggccactaccggtctccgcgcattggtggtagtggtccccggggcccagctgtcttttcttctatctcttcgtcttgtgtctttatttctacactctctcgtctccacacacggagagagacccactgaccctgtggggctggaccctacaccacctcagcctcccaaaatgctgggattgcacgtgtgcctcactgcacccagcccaacatatagatttgtgtttgctcaccactgggccccaggggacctagcacactgccctgcctaggacattgtgggcaatcactgtgtatctgttcagtgaccaagttagaaatatctggaaagatgtatgccaaactgtttagtggtgctcacttcaagggaatgcgattgaggaaaataaataaggatagagggctttatgatatatacatatggactatttgattctttttttcacaataacatgtaggactttttcatttaaaagaatgaagttttttaaaaaagatttattaccttggctttgaagtttctgcttcaaaattattattagagtcatcttttggagggtaggaaaaaatagcattttctgtggtccggttggtaccaggatactttgagagagctactggagttaggaaatgggaacggaaaagcaaagaagaatggcaaggggaggagctagcagggagagcgaggggagcaggaatggaaatatttttcatttctctttgttgtccttaaatggattgggaaaggcctgaagatgctctgccgagtaccacctctgaaatacaacccgccagggagaacaaagggaaacttttctccagttctccaccaactgttttcctgggtgtgagacctaagagccctgtaggaagaacacaagtgccgaagtgctgcttttcattgctgttggctgggccttcctcttgtctacagtttgtttgtttgtttgtttgaaacggagtcttgctttgtctcccaggctggagtgcaatggcacgatgtcggctgaccgcaacctctgcatcctgggttcaagcaattctctcacctcagcctcccgagtagctgggattacaggtgcctgccaccacacccagctaattttcttgtattttaagtggagacggggtttcaccatgttgaccaggctgatctcaaactcctgacctcaggtgatccgctcgcctcctgtctaaatttatcatgagcagaaaggcaggcacttcagggaatgagttcatggttccctcttagaagcctctgctggggctccgggctgaaaagcagcctgaggatggccactgtttagagagggtgtcctgaacaggagaaatctcctctgaacctgcctgaggcagttatggtgaagtacaggtgacccaggcgaacacacacagcttttgaattgctgtcacgggagagcaactcttcactgaggacctaccctacactccctttgagcatatctcatcctccaaacagtcctgtgaggtgtgtttactgtcattcccactttaactttgaggactctgaggctcagagatactgagtaacttctgcaaggtcacacagctcatctatggaggagtcaagcccagagccgtctcccttccaggtggatgttattactgccccctccctgcaccccgccacagccccccaacccctaccctccattgccctgttgccatctgttcttcctacatgcttgggtggagcacaggtaacacactttctttgcacaactcttgacaacgcttaagaagggaaaaaaaggtgtagacaataaaagggtggggttgtgactgtgccacagcctggtgctgtgtttatatgtaaggattgctgtacagatcataaatagaatagtcaagatgtgggtcagtcttctctctcttgttagaaatctagaaggggagcatgtgtgtttgccagatcctagagtttgctcagtgaattcatcagggttctgcagagagagaatcaacaggattacctccgtgattatggaggctgagaagtcctgtgacaggctgtctgtgagccggacaccccaggatgctggtagcatggctcagtccaagtctgaaggcctcaggaccagggcagctgatggtgcaactctcaggccaaggccaaaggcctgaaaacccaggggccactggtgtaaatgctggagtccaaaggcttgggagcctggagtccttgtccaataacagcagaggaagagtataactcagttccagcagacagattgacccattcaccttttctctgattttgttctctctggactcccagcagatagaatagtgcccactcacattcactgtggctcttccccacctagtccactcagactcacatgctaatctcctctggaaacaccctcacaggcacacccaaaatgaatgctttatcaggtttccaaacattccttaatccagccaagttaatacctaaccatcacactcagtgtcattgtctgttccggctactgtaacagaataccatagactgggtggcttaaacaacaaacatttatttctcatagttcaggaggctggaaagtccaagatcaaggcactggaaaatctggtgtctggtgaagtttcacctcctagttcataagtggccatcttctcattgtgtcctcatatggtagaaaaggggctgaagagttctctgaggtcccttttataagggcactaatgtcattcatgaggtctccacctcatgacttaattacctccccaaagtcctacctcctaatatcattatattgggggttgggatttcaatacatgaattttgggtggatatgtcattcagtctataatacttagtgtattaatccattttgatgctgctgataaagacatatccaagaccaggtaatttatacagggaaaagggtttaatgaactgatagttccgcgtggctggggaggcctcacaatcatggcagaaggcaaggaggagcaagtcaaatcttacgtggatggcggcaggcaaagagagagcttgtgcagggaaactcccctttttaaaaccatcagatctcatgagacttattcactatcatgagaacagcacaggaaagacctgccgccatgactcagttacctcccaccaagtcccttccacaacacatgaaaattcaagatgagatttgggtggggacacagccaaaccatatcacttagtattttttatttattttttttatttatttttcattttattttattttattttattttagagacagaatctcgctgtgtcacccaggctggagtgcagtggcgcaatctcggctcactgcaagctccgcctcccaggttcatgccattctcctgcctcagcctcccaagtagctgggactacaggcgcccgccaccatgcagggccaattttttgtatttttagtagagacggggtttcaccatgttagccaggatgattttgatttcctgaccttgtgatctgcccgcctcggcctcccaaagtgctgggattacaggcgtgagccaccacgcccagccaatcacttagtattttttaaaaaggcataagaagataaagaatatcttattccactccctaagcaaaactgaccaaaccatttggatctaattagaaactctccattctatagcattaatctatggaaagaaatgaaaagggaaaggattcattccttggacaaaccttgattttacatttttaaaagctataatttcaagtactaaaaaggcagagtgaaactatgatgtttcacgtggaagagaagacaattaccatcatgttcttccctgagaagggcccttatccaaagggtctggtgtgttcaaacaccaactggctaactctccccacagcccctcagtgcccctcagtggacagtcatcgctagggtccgaatgtctgtgtccccccaaaatccatgttgaaaaccctatctgcaatgtggtggtattaagacatggggcctgtaggaggtgataaggtcatgagggtggagccctcaggcatgggattagtgccctttaaaagaggcccaagggagcctcctggccccttctacacatagaaggcaccatctataaggaacaggccctcaccagacaccagatctgctagcaccttgatcttggacttcccaacctccagaacggtgagcaatacatttctgttgttcatgaattacttggtttaaggtattttgttatagcaaccagaacagactgagatagccacagaggagttgctgctagggcagagacaggaagagaagaaatgctcaggctcccagtgtcgggtcctgccacaccagacccactctagtcccacagcctgcagtgagcacctgccttattccaggcatatgcttggtgctaggcatgtaaatggaaagattctcaacatgtctctttcagaagcaaaaactggtgatgcaagcagttccaaactggccactagacaaagctatagagtccaccagttgcttctgttccactgcttttgtgggctgcttccagtccagagaggctgccctgcagggccctggaagataccagaactgaccaccaccctcctcctccacctcctgccaagcccctggaccctgctctgctttcctagtgacccttccctttgggtgagctcctctctggaacagggtcttgttctgtcatcagattcagtcaggggacctcctgaatagaagtcctggtagcatggagtctcagaatggaagagttagttctcaatttgttttttctttccaagaggttccttgactccagtgcaaattaattaattaattaatctatttatttattttgagacagtctcactctgtagccgaggctggagtgcagtggtgcgatcttggctcactgcaaccaccacctcctgggttcaagagattctcctgcctcagcctcccgagtagctgagatacaggcacccgctaccatgcctggctaatttttgtatttttagtagagatggggttttgccatggctggtcttgaactcctgacctcaggtgattcacctgccttagcctcccaaagtgctgggattacagatgtgagccactgtgcccagcccccagtacaaatttattaacctccttcccctactaaaggaatactgggaacagcaggctttgtcaacctacaaaaggttctgttaagcaatggatgcctgttcaactgacacttgcatacttactcagggagcactctcaagttttgggaaaagttcaagatgatc

SEQ ID NO: 547 - DNA, 5167 bp, Homo sapiens
cattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaaaaa

SEQ ID NO: 548 - DNA, 3083 bp, Homo sapiens
ggcgtaagatggaggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagcgcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgggtagcagaactgtctgccacacagtgttgcaaaaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacaggcgcggactctgatgagtctcccagctcctcagacacatcggacgaggaggagggccctgaccgggtgcagtgcatgccatcttgaggcctcatacccaggtggggcaggctggggctgccaacctgatcctgcctgggcaaccctttcctgtcccaggccctacattcagcagaaacgcactttggactttttgctttagataaaagaaagacacccccagcaaccccatcccagaatcctattttcctgggaagtccttaaagcccctaaccatcccacactcttcactttcctttccactttattcattcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggctacagcaaacatcattcaagatgtccagcaaagggagcagcacagatggcagaacagacttagctaatggaagcctgtttagcagtccagaggagatgtttggagctgaaaaggggagggagacatcctcaggcattgaagtggaggcctcagacctgagtttgagcttgactggggatgatggtggccccttttcccagcagctctgagaccagatgttggctgctgtacttactccttgaggtagggaatgtgtggtgatcgagtggtctgtgttcctattgctggtggggtgatagggtgggctaaaaaccatgcactttggaatttgttgtattttctcccagtaaagcttttcttctcccgaaaaaaaaaaaaaaaaaaaaaaaaaaaaa

SEQ ID NO: 549 - DNA, 1639 bp, Homo sapiens
agcgggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaaaaaaaaaaaaaaaaaaaaaa

SEQ ID NO: 550 - DNA, 3687 bp, Homo sapiens
gtttccgggcgggcctccagaggccggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgcttttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttcaaaaaaaaaaaaaaaaaaaaaaaaaaaaaaaaaa

SEQ ID NO: 551 - DNA, 806 bp, Homo sapiens
  misc_feature (431)..(431): n is a, c, g, or t
  misc_feature (461)..(461): n is a, c, g, or t
  misc_feature (545)..(545): n is a, c, g, or t
  misc_feature (564)..(564): n is a, c, g, or t
tcgatgcactccagccgctgtgtgtggtagtagtagccgttgctgcaatagcatgagtagcccggggccgtgttcacacacacgccactcttgcacacctggtctcggaagagctgacattcgtccacgtctctccggaggctcaggtctccactgggcgccaggtagccccggccgtgagggcacaatgactggtactcagctgtctcggtgcccgggcactgctggatgcggcagccgctgccccagccctcacccacagtacagcagcactcctgccatgtcacattccgagccaggatgttgtcacatgcatccggggccgctgtgtcaaagtagcactcccggcgcccactccccacagggccctgcctaggtgtgctgggtcggcggggcaggggtggcggaggtggcctggcgggcagaacggngctagcaggtgcctggggctgcgagcctgngaacgtgccagcagaagttcgtgggggaacacagcgtccagtcatggggtcaaactcttccggggctgttgggcagacacagangaaggagccttcgacattntcacacagggcagctccacatacaccctgtagtgttcacactcgttcacatccttgcatccgcccccctgcgtgggctgatagccaggtcacaggctgtgtgcagcggtagagccaaggtgtctcacacgctggctcacaatctcggacatatcttggcctcatccctcgtacagtgcctcggggcccgtgtaccaggatgagcccgacacaggtagagcccgaagttacaggtggaccgaa

SEQ ID NO: 552 - DNA, 9078 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 553 - DNA, 4762 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaaaaaaaaaaaaaaaaaaaaaaaa

SEQ ID NO: 554 - DNA, 3063 bp, Homo sapiens
tgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcggcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtcccttcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccacatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgcacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagactccgggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgatgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaatt

SEQ ID NO: 555 - DNA, 479 bp, Homo sapiens
tttgttccaataaaactttatttacaaacacaggctgtgggctggatttggcctgcaggctgtagtttgtgatccttgattcagacagtttagcaaggctgcaaagaacaccgacacccccttgttacccacagatgggtgggactgcgttggccagaggccgagaggagggtgctcacaggggaatgggcagcacgtagaggccgggaggtgctccagggcaccaagtgtgggaaagtgggacatgcggggaagtttccagaaactgtgatgtcaagttggaggcggagtgctgctggggtgtgaagggtctcgagtccaagtgagggagttagggacttgggaggggttgttgttgggtcggggacctggggtcagccaggtggtgacctgggatggggtggggacaggcaatgaggtaagctctgctctttatttttttgcagatgcttttctcaaactttcctgatcctgcgggc

SEQ ID NO: 556 - DNA, 523 bp, Homo sapiens
  misc_feature (492)..(492): n is a, c, g, or t
tgggctgcggaatgggaagcagtttatggagttaagtggggctctgctatttcccccaagaaggactcggaagatgttgattccagggcagagtgaggggcagacgggatgaggctcttctgtaaagtccaacagacgctcacagatgctgggaggctggggactgccaggttgggagcctcacccagagagcctcactgcattgaccccacacccaccactcacccagcacacagggggcctctcctcacgctcccaggccaccaggatggcccccaggttcacacacaggcacacgcacacacgctgcactcaccacgcactgaagggcatcacagccccaagtctgggtaagaaattctccaccaaaggtgttaaggaatttgctttgctgaggagaactggatgggtgggggaaaacagcaacaaacaaacaaaagaaatgcacagggcctcttctcatctggtgagatgagctcacactgctcaggngatgttggggaacagcgaggtgtgaggtgtg

SEQ ID NO: 557 - DNA, 6335 bp, Homo sapiens
cgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcaatggggtgctcagagcagcaggcaggttgggggaggggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcgggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaggcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgcaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagat

SEQ ID NO: 558 - DNA, 2090 bp, Homo sapiens
cccgtcctattcgggctcccgcctctgttcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaaaaaaaaaaaaaaaaaaa

SEQ ID NO: 559 - DNA, 2387 bp, Homo sapiens
cctcgtgccgcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcatgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactcttaaaaaaaaaaaaaaaaaaaaa

SEQ ID NO: 560 - DNA, 792 bp, Homo sapiens
  misc_feature (496)..(496): n is a, c, g, or t
  misc_feature (778)..(778): n is a, c, g, or t
ctccacgctgttcacggtacagattctcagtacccggacctcgttctgctgcccgatgcggtgagctcggtcttgggcctgcagatcctgatgaggattccagtcgctgtcaaagatgaccactgtatcagctgcctgaagatttaagcccaggccaccagctcttgtgctcagcaagaaaatgaaatactgggatccaggttcattgaatttcttcagccaagcagcacgatcttcagacttggtggtgccatcaaggcgtaggtaaaggaagttccgaaaagcaaaataatcctccatgatggtcatgagagatgtcatctggcagaaaagcagcactcggtgattagtcgctctcaattttggcagaatacgatcaagcagctcaaacttccctgaggcccgatacagttcagccccattgatgaccccatttgaatagcctaggtgttcagcaaaggattcctcaatgtgctgaaacatatatgggtggttngcagattttctcaactgcataatagtgttcataagtgtcttagcacctcctttccccttcttatctttctcagaaccatctgtgagaaggatccccttggcttgcatatggcgatacagaatcttctgcagagctgacatgtcacacttgatcacatattccactttttcgggaagctgggattcaacttctttcttcagtctccttagtaaaaaatgtcttaacaccctatgtagacgcctgatgatcaatatagtttcttcttcatttaagtgcaccccntcaccaggcatggg

SEQ ID NO: 561 - DNA, 922 bp, Homo sapiens
gttaagaatgtcagtatacaggaaggaatagaaaactgatactgttttaaataatctgtaatttcaatttttttttttttttggctgaaatactttatatgggtacggttcggaaataattctagtcaacaaagtataataaacactagatgtataataaaccctttaaatcatgggtcagtgttcacgtggggcgacctggaagcatttactgcgacaaagtaatggttcactctaagggtgtactggctcgtgcgttgcgccacccggtgtataattggcttcatttccttgctatttggatacatagggtgcattctctgtcactgtacctatggtaatgacaaactttctcatcttactggccaatcaaaatgacttggataggaatgaactccagaggcggggccttgaacagggaggtggtcgctcaggcctggtgctcagtcgtacgaccgtgtacctctcaactttggccctatctgtgaacatatatgctatgtcaataaacggctttaaataaaaaaaacacaacaccaaaaaacacaattttcggcggcggcacgacggccggagagagagtcttaaaaccaacttcgcggcggcgccgggcgcccacagtgggttacggcactgcgcacacaggcgtcccgaagaaaaccccggcgcagaacacagggcgggcgtctctcccaaaaaaaaagcccgcggggaccgcgcggttcgaaccaaccacagggccttggggcacaaggtcgactcccacggcacagaccaattataccgcccggacgacggagaccacaacacacaacgcaagccacaacacagtatcaacaatcaccaacagcatgacagccaacacaaactcccccacacaccacacgaccaccacacacggcacccagacactacacgacgc

SEQ ID NO: 562 - DNA, 154390 bp, Homo sapiens
gatcaaagggtcctccctggccacttccacctacaggaggtcaaaaatggagagagggaaaacaggttgatatcctgaaccttatggggctgggcttcatccattcctttcatgaatatgcacagacacatgtgcaaacacacacatacactgagctgtaccatgagcaaggcactgtgccgagtgtcaacaattttaaaagatttcacccagctcctgcctttgaggagtgcatggtccagaggaggaagcacgtgatagcagtgtagtgtgaatggtgctggaataggctgatggaacctcatgaatgcacggagaacagaggcctggtgccacccagtgtggacgagaggatggcatagcaggactaagaggtagccaggagccagctcatgaaaggccttatatgctgagccaatgctattgagattggactttgtcttaagagcaatggggagcaactgagcagttttgagcaggacagtggaattatagaatttattctttgaaaatattcctctggcttccgtgtggaggaaggattagaggtgggtggccagtgagggctttgcagttatccagcttagcaggatggagcactgccaacccaaccagagcaaatggggaggccaccagcctcaccctgaccctggacatgcccaccatgatgggaagacacagactgttccacaacaaccccttggaccccagcccagccctggaagaaccatgtaccttgactggcagggaagcctccactccgggcctgggcacacatgggagggtagggccccatgcttggtatgggctcaggctagcgctgctgccctggagtcagagctgtgtagagaggggcaagccccactcccagagagaaggagccacatgccgtgatggcaggtggtcggtgcagaccctcagctgttgggggagtggtcgggatgcctgaaatgtctgggaccgaggttctgggtgcagcctggagagttggggctgtgcgttcttgttgccattgttacattggctcatattgctgagtccttattcattaggctgttgggtacttttagacacacacacacaccagtctggagcacagagaaaactgtcataggcactcaaaattagagcaagttagataaaggggccagtaagtacagacctcacatgcccccagtggtggattcaggggtcactgattctatccattcctacagatgaacaggataaatatacctccgaccccgtccagtttttctatcccatttaatcactcctcagctgagaaagccagaaactcattcctgacgtggctgacaaatgctggggaaatctttggttttcttagagtgagcctctctttgtaaccagagagcaagagaaggaacagggccttaaaatcacttcaagtggcctgtgcctgatcctgaggtccagagaaggagaatgacttattcaagatcacagtttaatcatacatgcctttatccattcactcagcaaacacagttcaaacacctaccacttgccaaaccttctagatagttattaccaacataaccaagcaaagtatatggaatgccagatggcaatgggtacaggagagaaaaataaattggacaaggggatagacagtgctttggaggtagaggcagctttaagtagggtcacactagagtgaagatcgcaaggaggtgaagcttattctgggggaagaatattctaggaaaaggggacagtgagtgcagagtccctaagacaaggcatgctggggcgccggaagaaaagcagaggatggtgtagctggagaggaggtagccaggaggtgagttgtaggagattaagtcagagatgtgcgaggtatgagggagaagttcttttgtagagacttcaccttgactctagtcggatgggagcccatgtgggctctgagcagaaaaggaacagctctgacttaggatttagttggctgctgtgctgtggatagacagacagttggcaagcctgaagtcaaagagtccatgtaggagatccaggcaagaaataatggttgcttgaaccaaggaggcagtagtggaggtgggaagaggaaatcacacagagtctggccagattatggaggtaaaggcaacagtattgactaaaggaccaaatgcaagatgtgagaagaacagagtcagaatgaccccaaggtttttgtcccatgctgctagaaggaagacgtttcccattagccatgttggaggataccacaggagaatgggtctctgtttgagcatcttattcaagatgccattcaacatctagtgaaggtggacaggagacagtggacacaagtcaggacctcagggaccaggtcacaggcagagctagaccttgaacttcaagattcacagatcacactgcttctgactgaggagtgacagaagtgccagagcaatctcaccagctctggaatgttcatcacttgacggctgggctggcaatgaagaagctccatgcagtctttgggacaacactgcaccaagagaccacagcaacaggggagctcgcagagtagaacactggcattcaacccaaagcctcactgtttccagatacaagtgaaggtaaattccctgcccctccccctgccccaccacattcatccatccttgaagaactcctgggagctcactgggaaactcactgagcagtgagtaatatggttttgcttaagccttgctcaagtagcagaataagcaagtttgactaaaattctctagattcacaaatcccaaagccctaaactacagaaaacagactagtcaagagagaggaagctgtctgctggctatttgtggagcatcacccaatcaatgaacaagtatgcatagactgctgggtgcagagggaggggtgtttaagggatgtcttaatcgggttttccagaagcagatcctgagacaaggatttggttgcaagtagttatttagaaagtgaacccaggaagcaccagtaggagaatgaggaagcaagacaggtaatgaatgtattagtgaactgatcaccactgtgagcaattaggctcaattctactctaggaggctgtacagaatgtatctcagggttgtcccaccaaggggcaaggaaactgaggtacttatccactaactctcttttgttgttgagtgttcttcccacaaaccttaacttccaggcacttccagtttgtccctttattaagctgaccaatctcctgaggccagagaaagccttccagcagagaccagcaggtgtttccagtaggacactgtctgtgtgtactgaaaccagagtgtcatagggaattagaaggacgcagcaccaaccataatgggtttcacaggaactgcctggtctccacaaatagggactctaattttggtctggattctaagaaccaccttcaccccagtaaataggactgagatgacttttatcattcctgtaagcagagatagaaatgccagagcaaagtctcattggtccacacagaaagaaggaagcctcggtgctctttaattggagaccagagctgtggcaattcccaaccagtgtcagaattttgcaatgtgttggagacaggcagccctccctaggaatctactgagagacccagatctttgggcccttagtgagtgtttgagtaaataggtaagcagtggctgcggctcaggcaggagggtcctggaagttaatgtcccagcacagagcttcagcccagaccacagtgccaacatcctagcccttctggttaataattatccctaattccttagcgtgggaggcctggagatgaaaatcacaactctccatgtcctcatcagtctgttgtatgtgcatgtgtaccagatacctacatgcaacctcatgaaattccagacattctcatcaacaaatccctttgtcatcttcataaaatccaaagttaaagggcccaccctaagaattgtgactcatagattcctggatggatcaactctatgtgactattagagctagttttctcatgcccatattgggcaaaacctggtaaacagcacccctgtctctccctccccaaaattctgtctggatgagcagtcccttatgtaacaagctaaaacctttacaactgaccatatgtcaggaaacagtaaggtgtttacaagatacatgagaggggagtccctgtctttcaagagctcctgagtcctgccaatgaacaccttaagtacctgccctttaggggatacttgctgaaatcattccttgaatagaatgttagaatggcagaatgacagtggctgccaccgataggtcagagcattaaggactgggtcttttgaccgaccctaggatctctcttcagtggaactctgcccccaccaaccctattcagcctcctcctctatgctcaggcagctactgcttctcagccatcagtacaggctacctcattcaagttgaatttgcaatggctgttgtggttttttgtttttctgaccatgtggggaactctcatataggctttggaattatatagtcctggtttgtccaaagcactctccacaaacaggctgtgtgaccttcaaatagctgcttaacccctctaagcctgtcatctgaaagtagaaatgataatgataacattagagtaaaccacatgaaagtgtctttgtaggttaaaaattgttgaatattggcagtctcataggttccacctaaaacctttgtggggttctggggaagattcggtaagagaatatatgtattactgctagggcctcagatctaactagtttaggaccacagaagaaggtcacgttccccttagtgtctgaaccacatctcctgtcaaatatctacaggataggagttcgaagtctattcttacaggattcccagtgatttcaggaatccttgtggcctcttattccctcccttgtgttcccctcataaagatgttgatgtttattgtgcgtttactctctgccaagtattgtgccaggctctttgtacataaacatcgatgtacctctctacccatgtgaggtgggtgcttctactatcatccccctttcacagataatgaaactttagatatgagctaagaggaatgaaaaaattaaaaataaaaaaaaagcagataaggaaactaaagtgcaaagaagcaaaatgttttgccaaggtcacaaggacctcagggtccgtatggttgtaagaagcagactaggccctaaggtttcttccatgtctggcatcctagggggttaggactgccactgagatgctgaacaaatgataaggcaggcacttccccgacaaagaatttgtgttggtggcaggaggagagaagaaagctgcgaccaggagagctgagccaggagcttttgcccacctcatcatctaaatgagcatcagactctcaggtgttgcagataaaatcccctggcatgtgatcataggtgacatctacccagcgctcatgatggtaatgccaggcactactccaagctccttacatgatcaatcatttaaccctcacaaccttggggtctaaacagtactgttagtcccattttacagatgggtaaattgaggtatggagctgttaagtcactggcccaggatcacacaaccaataagtgacccagctggagatggaacacaagcaggctggctcccaagtccatgacgtgaaccataccagatactgcctgtcagaagtgtaaacagccctgtctcataatcacctcctttgatttggaagcctagaccaggggtcagcaaactatggcctgagagattcagagctaaatctagctgaccaactgtttttataaataacattgcattgaaatacacccacattcatttatttattgactgatttgcaaaaaacaagggcagcagtgagtagatgcaagagatcataggcctgcaaagcataaaacatcaactttctgaccctttatagataaaacttgttgacccctgacctacagtatgcacctaaggtgtgtcctatgtgtcctaagatggctccgacacttgctatgtgaccccagacaagttgctttcctgaatctccatttcctcatctgtaaaatgtgcttgtgggaatttggtgaggaagtgtgtgtatgtgtaagtgcctgacccaaggcaggtgtttgataagggtttgcagctatcattgccaatagtatgatgaaaattatgactgattcctatgatatcactgaagacagggcagagacctttatggccactttatgggcaatgaaaccctggtgcagagagaggatatggtgagaggcagagcccaggtcttcccagtccaagtcctgcactctgctgcctcctttcccccgccttccaatccatagctgccctagtcctcatttatgtttgccagcgtgcggagcagcccttctgtgtttgtgagttttcggcatctgtaagtacccacagccgcacagagctcgccagcacagacatttgtcaaagatgacatgccagtcatccatgccaccggagacagtgacagatgcgctctccagccccaccatccaggcagtggaggatagatggggccttggcaccggcgcccgctcttggcctggcatgtgcagggagctgcagaccaggcaagagacaaattgcagcctggtcagtgggcaggaggctcagtgtgcatgcaggcagatgtggctgcagcctgcccctgaaccagacacctgcctgccctccccagtgtcctagacctgcccaaatctggtgtttgcttaagatttgtatgtggtcactgatgaggaggtgagtgctcacgggctttgggttgtttccaataataatagtgacaatggctgatgctaacatatgctgctctgctgttctaagtccttagcatacatcgagctctttaatccttagccatccggtggtggaggtacaggaaactgagcctagagaggttggaggcctcttccaagttcacacattaagtggcagaggcaggaatcaaatccagacactctggctccagagttcaatgcccctcaggactactgtctaatatttgagagcctggagtggaggaaaaatcgtgactaggcaaaggattcaggtaggcagggctcaccactaacctgagtggacaggaacaggttgccctgcctcaatttttccaccagaaaaaatgagcagtggctgctattgcaaggccctgcaaggtcccagaccagctccagggcaggcctctctgttcttctgggacccttgggcactaggtcctctgccgacacacattcactccctccgcctaataatcccaacccagatcccctggagtatcatctcgtagttcattaaaccatcacctctgtgtccctgaggcaagcttgcagtctgttgagattttgtagggatgtttatggctagtggcagcaaagggaacagaccacataaaacaaaaagagacagtatgagctcttaaaaagtttccaaagtctggcataaaagctcccacaggtgtttcattcatacaaatgaccagcttccctccgctctggatgaagggtttggaaagaccaaagtctggttcagtccagccagtctcctattgtgggaccttccttgcgaaagtacccttctttctctgagccttggtttccttgtctgtaaaatgggtataatgatagtacctatctcataaaattattgtgaggattaaaacacaaaaaacacttagaacagggcccgacacaaagcgaatgctcaacaaatgccaactgttctcattctctggtttttagtttcctcagtgggaaaatgaggaggtgagttttgtgccaggtatgggcttctggctcgaacattctgtgacttcatgatgttcctagggtgcttccttgtctcctcccacttgcctgagtctttcttctttgtttctgtgagccccagccaattagtttactcacaagtgtagggtagagagaactacacaaacaggaagtgttaccactcatactcacagtggtgaatcattccaaccttccatcaagtggatccacctccattggtcgacacagctggggaatctgagctactgtggccagaactctgttgaccacatcctgcaatgacagacctcagaatccttcctgaaccttccatgggaaggagtctgtgacagcccacctgtgtagactgggcctcatcagcctgaatttgctgaaataagtaattccagtttccctgaattcatgcagagggcacccacgctgggaaggagtttctctggcttttcaagctccataaacacttgaaaagtcattttatttttcaatctgtgggcaggatgccaccaaacgaggaagcctcattaaacagaccttgaaggctatttctttgttgttttttttgtgggagtgggatgaggtttggtgttggcttttttttcccccactgatgctttttggataaacacataaatcagcatcatctatattcattagatatcgtgccttgttcagtacaaaattacccctgttttgcatgactttccccccttgtgattaatataaatgacttaagttaattatgtttctcttcatggaaaaatgtatttgtcaaagtgctgaaacatcaataaaaaataaacactgtcatttgaagaagggctcatttgcaaatgagtagctggggtgtggggaaaggaatggactcacccgtctggaggtgtcattctgattgagtaggcacacttcatatttactaacaatgacaaaagcatttttcttagttaagcactcacaggtcctgatgaggtagactgatgtcatcattattaacaataatgacacctcaggcgtagagaaaacaattttccttactagagaaaactaacgctgggtattttaccatccagacctccaaaactaggcccagcatggggactttgcaggaatagaccaagaggcaaatacagatgattggagtgggagggaagagaagtgaagaaaagcaaaccatggagctggtgtggcatctcagagcaacatggaagcttagggatgagacagcacaaacacctccctgggccaatgacaagactaagaaccagagaggggacttgccccttgggtaaacagcatattagtggcagagcccagagagaacccaggactcttgactcctagacccccaccctttccctgcactctgctgcctcccttgccaccagggatcaaaggctccccctcacttgagtaagtggtcaatggcaccagcaaggtgcaggggctcagactgctggacagtcagggccccagggaaatctacaggttactgacttttttcatggtatctggaatagcctttccccacactgactgtcttagtttgggtttcctgaaggcagaccctgagacaagatcgtaggtgctggtggtttatgtaagaggtgagcctaagacaccaagtgaggtggagaagtgagacagggaagggagaaaagccaatacagggcacatgtatgagggggttactgctttggacacttggactcactccccccaggagtgactgcagagaatatgcctctgagttgtcccggtgctggacagggaagcagaaatatttatttactgacctctggggactttaatttccaacccctctgggtcaccctgtacctaagctgagcaaactcccatagtaccagaaaaacccagagatccaaaaccctgagcaggtgagtgggaagcgctagtgggcacagtcactgtctatggcagatgcacgtgaacctggaggtggtatggggggatgtgggtggggcaggcatgttatctactacatcacccttatctaagtgctcccagccttccaagaaatcccccctccaagtaaacatgatcatcttgtcttctgatggtcagaaaccattcatctggccaccttattttacttatcttcttaaatattatttctgtcaccctaaatatactgtaaagcattcaagggcaaaattaaggccattatcattctgtcattcaacaaatacttactgagcacttactctgtgctggactatctttaaggtgctaggaatatagcatcaaagataaagaaaatccttgtcttcaaggaacttgcatcttaaaagtagagctagacaataaacacataaataaatgctataatttcaagtggtgataagtggctcaaagaaaaagaaagcagggtaaaggggatagcataatggaagtgcagtactcctggggacatttgagcaaaagcctgaatgaaataccggagtaagccatgtaagaatctggtggaatggaattcaatcaaagagaatgtcaatgcaaagaccctagggaataacaggaaggctggtgtgacactcagcggagtgaaaaagaaggtggtaggaactgaagaaggggacaaccagatcgtctaggaccttacctttaaacagtgcctggcacaaaagaaaggtactccaagctgactggatggatagatgggtggatataacagatggaaggatggaaataatgacagactagtggatgaagaaagaagaaaacaaagcaggttctataggtagagtgtggtgccaatggtgcattcaaagccagactttgcagaaatagcaaatattgaacccaaagtacccaatgagtagttattagaccaaggaagcagttgaaggagaaatgttcctctctgggcttcagccaatgagaatcctagaaacctgagtgtccttatctttctttacattccctgcagaggcccagcttctcccctgtggtgagtatccaataacattaaatggtattacagtggattaattaaactttggtggctggaagctagtgaatcattccctccaccacatattaccatgtttactcatcagggctccatttttaatagcggtcttttaattaaagcatgtcaccacggtccattagggaagaatttggaggatgagatgtgcatgtgggtgcaagcatcatttaattcagcagttctttactgagtgcctactatgtgcctggcaagtcttgaggtactatgagaaaataaggtgcaagtgaagggcttcaaggaacttacgcgatcaaacaaagtgaattcacactcacgatcaactgaggaacattggcatattaatcattgcttgccaactaaccagaattctttattagtaacttctcccacctagtttaatttggaagaaccaggccaatcataagaaaaattctggggcttttcgttttcagcaaaatatccagggtatactgtggcctagaccctgatgcagtcatatatctttgggaaagcctcctaaaacttctgagcctcaatcagtctcttcaagaataaaagcagaggttgttcttatccagaaattctctagattccagctgtaacattttctcatctgcgaccctccaaatctccaggcccagaccatgaggatgggttttccagaatggtggaaatttcatctaaagtcactctaagatttttacccaccagagaaagatccttttcattacattcatgacattttgttttctgaattttcaaagaggaccaagaagacctgtttggaagtaggagtagttacaatgcatgcactatgtgtgcacttagatgaggaggaacaaaccacatactgccagaaaagcaggctctattcatggggtgactgggtaaaaggcattggaactggaccctaaagactaggtaatagtttgagagtaggagaaatggggggaaagagccaattttcagcctgattctagccatgttccaagtatgggtccccactttgcaactgcatgacaagctcccccaggaggagggaccaggtctctttttcttttgtctgagattcttccttccagctcttcactccttaggcgagctcagccagtctcataggttagggcccacctgtgtgatgatgactcccacatttccatctccagctcagcacctctctgcggagctctctattcagtcagctacctgcttggcacagcacttagaggcttcaagacatcacaaacaacgtggacaaaatgaggctcctatttctgtgtccagtctgttgatcctcattcttcaggtctcaatgtaggagtcacttccccagaatgtaaatatatatcttaccccagaatgtgtgtgtgtgtgtgtgtgtgtgtgtgtgtgtatatatatatatatatacacacacatatatgaatatatttgtttatatatatttatatatacatatatatgaatatttatttatttatatatgaatatttatttatttatttatttatgaatatatatttatttatttatatatatattatatatatgaaggaggggtcaggacctctccgatccctcttctataaacaccctaggttttccttcacaaatgttgtcacattgtcaggaaatctttgtgttgtgatatcttttctgtgaggtatttgatgaatggttgcctgtcttactggatttttaagtcccattgggcatagatcagcccccatttactcaccactgtctcctgagtacctgggactgtgcctagaacataataggcccccagtaaatatttgttaagggaaggcatgggttccccaaccccagccagtgtgcaagatccatttccgcataccactggcacacaacattcaggcactgggagccgcacagtgacggaagcttgaacattttcttcgtgtcaagttctcagtaaagctattttctcacattgtctcatgtaattcttaaaccaccctggaaggaataggttttattgctgtttccattatataggtggggaaacatggctcagaggaaagtggcatgtccaagatcacacatcctgcaggggacagacagaccaaacccatgttttcaccagcctctcatctcacaaacaacactaggtttgttaatacctgggaactctgtgtaagcgaggtccctggcttggtgtcagaagacctgggtttgagtcttgacaatgtcctttgtaagtagcttaaggtagctcctcagttccctgtgagacactgcacacaacatcctttaaactgccttaagaaaaacagccctacaaatgaagactccattgccactccctttgaagcagctgctctcagagtcctctgcactgcctcatctgaattgaactatctccccaccttctcgcagaatcaaaaactagaggctgcaggctgaagagggcaccattattttgtttaactcacagagtatttaaaacttttttttaagttgttgggtaaattctaacaggttttcttcagggtccagatttttaccttctcttgaaaaattagaagctcctgcaacatcagtcccacagctctgcacatcattgactggcatcaattggttgagccaagaggtagccatgctctctccccagtgtgccactatccctacctgaggctgggaatcaggtgtcacttaccttgacatctgttcccttatttttccaacaatgggaatacatttttctgcattcatgtcgctaacagaactaggaaaagcaagcctggaccacaaggatagtgcagtgagagataatgtgagtataattcttgatgcaagtgaagaataatcatgagttcaatatggttaagtgcatgtgtttcaaaacaacacaacccaaacaagattcagcaaaaatactatcccccagctctattttgttatgttgcctctatgacccctgtaagattttgaatttcagatgcttgcttcagttaaataaagagttttctagatgaaggcatgcagtaggtctctaacactgagccactgccttgtccctctcaattaacctttgtctttaagtccctgtctaatgcctactagtagctaggtccctgagattgtaaagaccccaaggccccaggaccctgaagagcccaggaagtatcagaccaatgaaccagacctgaggtctcctgtactcttcagcttctgaactataggagaatcccaaggaaaacagggcaacaacaacttataataaatagtaatactgccagaatcctatttgtatttaccagtttgcaaagcactctcattcattcaacagtcatatggcaaatataagttgaggctctattacagatctaggccctgtgggcgtgatgttatacttggtagtcaagatccctgaccttaggaagcttccagtctggccaggaaacatcagagaactaacatttctatagcactttaccatgaaccagtcactcttctaggtgctttacactgagtaactcatttacccttcatagcaattctaggagataagtactgctgttttccccatttcacagatgaagaaactgaggctacagaagttaagtaacttcctcaagctcagtggtggagccagccatctgacccacagaagcaagttgctggaggcaggcttttgggaccacagactgggaagatgatatcttcaccagtgaagatttccaaggccaacatcacatggccaaattgcatcaccccatggccctgggctcttctccctgttcacactaaaactcagaaacatttattcatggggggagtagtcagcacactggttgctcaggtctgagaatgccagggctgagctagcagggtttgcaggtcccaaggcaatttgcatctcctgttggaagtcttcctcatcaaagcaacggaaatcaatgcagtaaatagttataatgaactgacctgctcacactccctgtctcttcctgaggaagaggaatcatgagagacacattgtttccaaatccttcacctctttccccctcgcctgatcctcccacagggaatcctctttgctcctgtcaacagtgtttgagatgtttcagagtttttattggatcttcattgtagctctgtctgtgaggattcagtgaagctaagatttaagggccagagagagttgaaacttctaccaagcatcagccatggctgccctgctttccagagtactgtccacggacctctgggcctcagggactagagaatgtcaggggaccatctcatttcatacatgtaaaaactgaggcacggagagggcaggaccacccagcacaggatcagcacacctctccaacatcagtacaccccaccttttcaggcagatacaggaatctcctccgcagcaaagtgttgataggtgggaagcagtgctgtgatgcccttagctttggcatccaaatgcttgagttttaatgcctgacccaccatttccttgctgtacaagaccttgagaaagctaattaacctctcagtaactgttttctcatatataaaacagggatgaaaataaaagtatgtgctccattgagttgttggaagctttaataaacacaggaaaaaaattagaattgtgtctaccatgtagtaagtattcaataaatgtcagtgactatgcccatgatgaatatggtgaatatgattatgatgatcatgggcattatccctggtgctaagagtcacttctacaggagtttagcttgccctgacctagaacattgaggcagggcatgaactcaatgttgcactgagaaccagtctaacacaggaatgttttctctgtttcacaggtgtcagtcatgttctctggataaatgataagattgaaagtccttgaaggcaggagacagccccagatatcgttttgttgtctgacacaataccaagcacaaatgatgtgcctaaatcctgggtctttaacccaaggccatctacatatgccctgggcctgccagctcatgaaaaccagcctctgtggcagttggggtgctaaggaattgctccagttgagcttcactggtttttactcttggctgtcatgcttggatctcttgattatgttccatcagttcaccccctgcctctgggctgaaagatttggtgttctttctaagttttcttgcatgatttgtggcttagaacgtctttcccgtacatctctagccctttccatctcaaatgttgactcagattattggctcagggcaaagccactggctccagctcttaaccctgtagaatctcacctatccctggcacccaacatagacatccaccccttcaactccaccaagctagggagtagagagtagttgtcttttccatccattctctcccttcccctccttgtctaatttctaagagttaagagtgggcacttttccaacatttccgtggttacgggtaactatgtcactcaatcctggccacatgaggtgggacactagcccactggaagagttttcttcttaatagaagagagaaatctgtaagaataatcccccactgttcctaccttgggtgctattatgtgaggccttgatgcttgaacctgtggcaatgatcttgcaacatgaggaaagggtcacaagaattgcagagatactgactggagccctgagctgttaaataaaccaactccaaaccaatgggaatggggtatggaaccaccagtctctagattttctgtgacaaggaacaattaagcttccatatttcttaagcctattttagtcaagagctcagttagttgcaggcagaagcattccaaagttttatcaagtaagcatcaatttgcctatcacaaactttatcaaggtgttggtagattctaccttgtagacataatgtgatctactaggaatctatgtagaaaattcaagaatccaagaatttgggagaaaacttaaaagtcgtccatatctgacatatagatcaatggaataaaatggagggtccagaaacaaactctcatatttatggtcaactgattctcaacaagggtgctaagaaaattcaatgggggaaataataggctttttgccaaatagtgctagataacagaatatatccacatgcaaaatatgaattcagaaccctatcacacaccatataaaaaaatagctcaaatggatcaaatatctaaatgtaagcactaagactactaaactttaaaagagaatgcatgtataaatccatgaccttggattaggcaatggtttcttagatatgacaccaaaagcaatcaaagaaaaagacatataaattggacattaacaaaatttaaaaatgttgtgcttcaaagaacatcatcaagaaaatttaaaaaaccttgaatactgtatatattttctccaaaaaagttacacaaatagccaataagctcacaatgtgcttctctgctgagcccagagagagcaagatactactactcaactagccctttagacagccaccacaaacacatacgaacgggcacatgggatgaaatgtgtttaccattcccaatctaggacaacggtacccaaaggaaatgttggtgactatgcccatgatgaatgcttataaaccaacatttcctttgttttgtaaaacatttgaagccatgtccatggacacagaggaaaccatgacggcaccagaatgtctatttctgtccttgagatgatgctaagactaggatatccctgtgtctaggaactcactactattgtactggtgtagctcagtccatctttgaggaacaaaaagaagttctatttttttatttcaacttttatttcagattcagagggtacatgtgcaggtttgttgcaagggtatattgcatgatgctgaggtttggggtacaattgaactcatcatccaggtagtgagtatagtacccaataggtagtttttcaacccttgcccctctccttccatccctctcttgtagtccccagcatctagtgttcccatctttatgccatgtatactcaatgtttagctcccgcttataagtgagaacacgcagtatttggttttctgattctgtattaattctcttaggattatggcatccagctgcatccatgttgctgcaaaggacataatctcattattttttatggctgtatagtattccatggtacatatgtaccacatattatttatccaatccactgctgatgagcacctaagttgattccatgcctttcctattgtgaatagtgctgtgatgaacatacgagtacaagtgtccttttggtagaatatttattttcctttgggtatatccccagtaatgatattgctaagttgaatgatagctctatttttagttatttgagaaatctcctaacagctttccacagtgcctgaactaatttacactcccaccaacagtgcaaaagcattgcctattctccgcaacctcgccaacatctgttgtttttttactttttagtaatagccattctgactgatgtgagatggtatttcatagtggttcttatttatatttctctgacgattagtgatgtggaccattttttatatgtttcttggccactcgtatgtcttcttttgaaaagtgtctgttcatgtcctttacccactgtataatgaagttgtttttcacttgttgatttgtttaagttccttatagacctttgtcaggtgcataccttgcgaatattttttccctttctgcaggttgtctgtttactctgttgatagtttcttttgttgtgcagaagctctttagtttaattaagtcctacttgtcaatatttgtttttgttgcaattgtttttgaggacttagtcataaattctttgccaaggccaatgtccaaaagggtatttcctagatttttttctagggtttttataggtcgaggtctcagatttaagtctttcatccatcttgagttaagtgataagtgcacacaaattaaggtttttttaagtatttttaacttttttaaagtattttttaggtatttttaacccttattttagattcaagggtacatgggcaggtttgttacataggtaaattcatatcacaggagtttgttgtatggattattttgtcacgcaggtattatgcctcgtacaaaacagtttttttttctgctcttctccctcttctcttcttccactctcaggtatgccctgatgtctgttgttgccctctttgtgtccatgtgctctcatcatttagctcccacttatacgtgagaacacgtggtatttggttttctgttcctgagttagtttgctaaggatactggcctccagttccaaccatgttcctgcaaagggcatagtctcattattttttatggctttgtagtattccatggagtattgtaccacattttctttatccaatctactgtttaggttaattccatgtccttgctactgtgaataatgctgtgacaaacatacacatgcaggtgtctttatggtagaataatttacattcttttgcgtatatacccagtagtgggattgctgggttgaatggcagttctgtttttagctctttgagaaattgccacactgctttccacaatggttgaactaatttacactcctaccaacagtgtgtaagcgtccccttttctctgcaaccttgccagcatcagttattttttgacgttgtagtaatagctattgtgactggtgtgaaatggtatctcactgtggttttgatttgcaatcctgtaatgatcagtgatgttgagctttttttatatgcttgttgggcacacgtatgtcttcttttggaaagtatctgttcatgtcctttgcccactttttaatggggttgtttgttttgttcttgtaaatttgtttaagttccttacaaatgctggatatttttaggtctttgtcagatgcatagtttgcaaatattgtcttctattctgtaagttttctgtttactctgttagtttattttgctgtgcagaagctatttaattagatcccatttgtcaatttctgcttttgttgcaattgcttttggtatcttcatcatgaaatcattgcctgtgcctatgtccagcatggtatttcctaggttgtcttctaggggttttatagttcgggattttacatttaagtctttgatccatcttgagttgatttttgtatatggtgtaaggaaggggtccagtctcaatcttccacatatggctagccagttatcccagcaccatttattgagtaggttttccctcttgcttgtttttgtcagctttgtcaaaggtgtgcagccttacttctgggctctctactctgttctattggtctatgtgtctgttttttaccagtaccatactgttctggttactgtaatccagtagtatagtttgaagtcaggtaatgtgatgcctccagttttattctttttgctcaggattgctttggctattcaggctcattttggttccatatgaatttttaaacagttttttctagttctgtgaagagtgtaattggtagtttgatagaaatagcattgaatctataaaaatttcttcaggcagtatggccatttttacaatattgattctttccacccgcaagcatggaatgtttttccacttgtttgtgtcatctctgatttctttgagcagtgttttgtaattctcattgtaaagatcttttactttcctagttagctgtatccattctttaggtcttttattctttttgtggaaattgtgaataggatagcattcttgatttggctcagggcctggttgttgttggtgtataggaatactaattatttttatatgaatacattgattttgcatcctaaaactttgctggagttgtttatcagcttaaggagctttggactgagactatgggattttgtagatacagcatcatgtcatctgcaaacagagatagttttacttcctctcttcctatctgggtgctttttattgctttatctttcctgattgctctggccaggacttccaatagtacgttgaataggagtagtgaaagagggcatacttttctttttctgcttctcatgggaaatgcttccagcttttgcccattcagtaaatgttggccgtgggtttgtcatagattgttcttattattttgaggtacattccttcaatacctagtttgttgagagtttttaacatgaagggattttgagttttattgaaagccttttctgcatctactgaggtgatcatgcggtttttgtctttagttctgtctatttgatgaatcatgtttattgatttgtgtatgttgcaccaaccttgcatcccagggatgaagcctacttgatcatggtggattagctttttgatgtgctgctggatttggtttgatagtattttgttaaggatttttgcatcaatgttcatcagggatattagcctcaacttttctattttgttattgttgtgtctctgccaggttttggtatcaggatgatgctgaccttatagaatgaattggggaggagtccctcctcttcaattgttttggaagagtttcagtaagaatggtaccaattctggtagaatttggctgtgaatccctctggtcctggactttttttattggtatgctatttataactgattccatttgagagcttgttattggtctgttcagggattcaatttattcctggttcagtcttgggagggtgtatgtgtccaggaatgtatccatctcttctagattttccagtttgtttgcatagaggtgttcatagtagtctctgatggttctttctatttctgtggggtcagtgataatatcccctttgtcatttctaattgtgtttatttggatcttctctcttttctttatcagtctagctagcagtctatctattttattatttttttcaaaaaaaactaactcctggattaattgatcttttggatggatttttgtgtctcaatcactttcagtgcaatatgattttggttatttcttgtcttctgctaattttggggttgctttgctcttgcttctctagttcttttcattgtgatgttaggttgttaatttgagaactttctaactttttgatgtgggcatttaacgctataaatttctctcttaactctaccttagctgtgtcaaagagattctggtgtgttgtatctttgttcttgttagcttcaaagaactttttatttctgccttaatttcattatttaaccaaaagtcactcaggatcaggttgcttaatttccatgtaattgtatggttttgagtgattttcttagtcaaattctatttttattgctctgtgatctgagagagtggttggtatgattttggttcttttgcatttgctgaggattgttctatgtccaactgtgtggtcaattttagagtacatgatatgtggttatgcgaagaatgtatattatgttatttgagggtagagagttctgtagatgtgtgtcaggtccatttggtccactgttgaattcaggtcctaaatatctgtgttaattttctgcctcaatgatctgtcttatactgtcagtagggtattgaaatttcccactattattgtatgtgagtctaagtttcttcgtacttgctttatgaatctgtgtgctcttgtgttaggtgctgcatatatatttagaatagttaggtcttcttgttgaattgaacccttcaccattatataatgcccttctttgtctttttctttatttttgttgttttaatgtctgttttgtctgaaattaggatcacaactcctgcttttttcagttttacattttcttggtagatttttctctatccctttattttgagcctatgggtgtcattgcatatgaaatggatctcttgaagacaagatattattgggtcttgcttctttatccagcttgccactctgtgtcttttaattggaacatttagcccatttgccttcaaggttagtattgatatgtgtggatttgatcccgtcatcatgttgttaggtggtaattatgtcaacttgtttgtgtggtagctttatgatgtcactggtctgtgtacttgtgtttttgtagcggctggtaatagtctttcctttccatatttagtgcttctttcgggactccttgtaaggcaggtctggtggcaatgaattgcctcaactttgcttgtctaaaaaggattttacttctctttcgcttgtgaagcttagtttggccagatctaaaatccttggttggaatttcttttatttaagaatgttgaatataggcccccaatctcttctggcttgtagggtttctgcttagaggtccacgttagtctgatgggcttccctttgtaagtgacctgtcctttctccatagttgcctttaacatttttttctttcatttcaaccctggagaatctgacggttgtgtcttggggaattatctttttgtgaagtttttgcaggggctctctgcatttcctaaagtttaatgttggcctctctagctatgttggggaagttctcacggatgatatcctgaaatatgttttccaagttgcttccattctccccatccttttcagggatgctaatgagtcacagattcagtctctctacatagtatcatatttctcagaggttttattcattccttttcattctctcttctttattcttgtctgactgtctcatttcagaaagccagtcttcaagctctgagatttttttcttagcctggtctattctactgttaatacttggaatagcattatgaaattcttgtaatacatttacaattaccagccctgtcaagtcagttatgttattttctatactggctattttttctgtcagttcctgtatcattttattgtaattcttagcttccttaggttgtgtttcaacattctcctgactgttgatgatcttcatttctacccatattctgaattctagttctgtcatttcagccatctcagcccagttaagaacacttgctggagaactaatgtggttgtttggaggaaagaagacactctgcgtttttgagttgtcagagttcttgtgctagttctttctcatctgtgtgggctgatgttccttcagtctttgaagttgctgacctttggattttttttttcttttatcctatttgatgaccttaggggtttgattgtggcataaggtggattcagtcaactggcttcatttctaaaagattttagggagccaagtctcagctcaggactcctgggccacattctctaactctgggagactggtattgagccccagctttgttccctgactcctcgaggttaggaacctgatgcactgggggggccaagatgctgctggaccactggtcacagtgctctggtggatggtgccagccaaagcacttcacagggcagtggtagtgagctctgtcctcatttgcacatgccagtagcagtgcagtggcagtgcagcagggtgcatgctcagctgcagcagggtgttagtgggtactggggtgctggcctctgtgcaagtgttcacagcagcagcagtggcagcacagcttggggtgggccccactggacactgggcaactgtgcatgcattaacaccaatggtggtgttagcatggagacagggtgctagtgggggcaggactgtgtgtacccttgtgcacgtacatgagggcagcagtggctacccagggtggggacgggtccactgtttcagctggggtcaggcattggcaggcaaggctagcaggcttcatgcctactaatactctgacaacaatggcagttgggggggcagtgcactcaagtcagcagcagtggcatgtcagggtgcctgcacacacatatccttgtggagaaggaaaggcaaagtccacctgcacaaggtccacatgtgctggcaaagtgatgtggggagaccctgggtgagtatatacaggcaaagtggcacaggggaggctacagtaggggaagagcaggggtggagttagtgtgtgtccacgggtggctctgctggagcactctgccggtcaggtacagcctgccagccctgaagctatgatgcaggccaaggcagtacctgagggctgcactgcaagcagttgtggccaggctggggcctcaggagaggccatcagactaaggggtgctcagatcagactagtcctgtctcatgggcaagaccaccctgcagttccagtctaacagttcccctagggctatagtctcttatggcagcaagttgagcctaagaggatgggcatccctggccatgcttcactacagatgcccctacaccaaaccctctgggctccacactacctggagttcttccccatctcttctctaagcagcaattcctgccaattcaagtgtccatggtagtcgagtggtcacctcctggtggaattccagaggcccaaggttagagcaggttgctccttgcctgttgaactcaccccttcatgcaggcatcattgaggggcaggaacgagtcccagtgtgcagaagccccttgcagggttcccagcttcctcctgcttcagcccagcctctgtgtcttccttatattcaccctgaatgccttccctctgaagacatgctaggagtgcaccagtcttcctgatatcccagtctctcggtgagagatgttcctcctggctgtgtctagtcagcagccatcttggagctagtcctctgagctcagtttcattcttctgcatatggatagtcagttactccagcaccatttattgaatacggactttctccattgcttatttttgtcaactttgtcaaagatcagttggttgtagctatgcagctttatttctgggttttctattctgttccattggtctatgtgtctgtttttgtaccagtaccatgctgttttggtcactgtagccttgtagtatagtttgaagtcaggtaatgtgatgcctctggctttgttctttttgcttaggattgctttggatatttgggctctttttttttttggttccataaggattttagaagttttttctaattccgtgaaaaatgacattggtagtttgatcagaatagcattgaatctgaagattgttttggcagtatggactttttaaagaattgattcttccaattcatgagtatggaatgtttttccatttgtttgtgtcatctatgatttctttcagaagtgttttgtagtttttcttgtagagatgtttcacttccttggttagatgtattcctaggtatttgtgtgtgtgtgtgtggcgattgtaaatgagattaggttcttgatttaacgctcagcttgaacattattggtgtatagaaatgctggtgatttttgtacattgattttgtatcctgaaactttactgaagtcatttatcagttccaggagccttttggcagagtctttagggttttctaggtatagaaacatatcatcagtgaagagaaataattcgtcttcctcttttcctatttggatgccttttatcttttctcttgccagattgctctggctaggacttccagtactatgttgaataggagtggtgagagtgggcatccttgtcttattctagttcttgaggggaatgcttccaggaaaaagttctatttcacaagcaatcaaagaaatgtaaaacaaagcaatgaacatttgtttttcatccataatattaacaattagttaaaatataatattcagtggtggcaagggtatggtaagatagactcaagttctcactggaataaaatgtagtccatctgtagaataaagttgaacaatgtgctcttaaacccaggcattccatccttattcttatcataaaactcagagattaagatgggtgttaattatataaagtcattaatcaagattcttattgtacaagccagtaattgaaacaacttgtatatgcagcaagaagggaattgttgaccttatggaagagtagaatgatagatgccagcagctggaaatgggtggggggaatgaaaagaggttggttaatgggtataaacctacatttagacagaaggaataagtcctacatttaggtaggaataaacctacatttagatagaaggaataagtcctagtggacacagtaaggtgactatagtaaacaatttattgtatatttcaaaatagctaaaagggaagacttgaaatgttttgaacacaaagaattaataaatgtttgaggtgatggatatcctaaataccttcatttgatcagtacacatcacatgcatgtatcaaaatatcacatgtaccccataaatatgtataattatctatgaataaaaaaagaaaagaaagaggggaatggttacataagttataatatacctatatgctagaatggattttgaaatagttggatggcatcaccatataacgttacatttaaaaaccagggttccagccaggcatggtggctcacacctgtaatcctaacactttgggaggccaaggcaggcagatcacctgaggtcagaagttcaagaccagcctggccaacatggtgaaaccccgtctctactaaaactataaaaattagccaggtgtggtggtgggcacctgcaatcccagctactcaggacgctgaggcaaaagaatcacttgaaaccaggaggcagaggttgcagtgagctgagattgtgccactgcactttagcctgggcgacagagcaagaccctgtctcaaaaagaaaaaaccagggtccaacattaaaatgtacatgatttctaattacataaaaatctttgctaattcatagaaatgtgactggaaagaaatacaacaaagcactgataatcacagttactggacagtgggatgaacagtaatgcatatttctgtctgtattctttcctatactctccacattttctcaaataatcatgttttcttttttagaggaaaaacagcattattacaaaaaagaaaggagccaaagatcttaagtcaccatggctccttctattgcccgctgagctgtgtctcccaagctcactgaccttcagaggctttgttcataaaataaggacaatggtatctaagagtcttcacagaattgctgtgaagataaaataagaaaacgacatgctttgtaaattgtaaagcattgtacaaatgttagctgttactaacattataacacagaattaattccaataatctgagagaagagaaaagaaattcataataagatacctcaggctttgacataggaactaggaaaatacaagaataagctaagaatagaaagaagtaaaacatccacaggaatcctggagaatgttcactagcatatctcaggaagctcagagaaaacatttaacaagaagccaaaaaaaaaaaaattcacaaggcaaccaaatattaacagcactgcttggctaacaagccacacatgatattttgtctttaggttttttagctttctgttttgtttcattttgttttttcaagtcttctgaaaattgagaaatgatcaagttgggagaatggaggagttcactcattgtgacaggcagataaaaattagagataacttaggtcaaaatctattgaagaagcatcttgctccaaaagtcaaaatcagcacccagagggagaaaactggaggacagagagggcacttaatgatcacagggccaggactggactcagaaatgacaaggacccagcaaaaggattcaaattctttaccttgcaaaggaaaatgcctgtggccactcgttgctgcccactccttcctatacaagactctcctattcttgcttcttgagtgctcacctgtcccactcccctgcagctccctctctgacttcccttccctccccactccacactgtgcctgctctaagggtcctttttcactccctgctcttgcctatcctccctgttatttctccctgttctagctaacaccttcaaatctacatcttcatgcaggatcatttctcaacccccttaccatctctctaaatgcctctcagacacacacccccagaagccttgctgcccctggaaactaagcctgcagccaaatgcgtcttccttttttttttttttttttttttttattatactttaagttctagggtacatgtgcacaacgtgcaggtttgttacgtatgtatacttgtgccatgttggtgtgctgcacccattaactcgtcatttacattaggtatgtctcctaatgctatcgttcccctctcccccaaccccacaacaggccccggtgtgtgatgttccccttcctgtgcgtcttctaaaaaaaatgcgtcttctaaaaaaaacgcaaacaaaccagtgaaagtgggttcaatgtatccttacttgctagtcctaataacaattctgctagaaacaatttcctcttgtgcttcttcttctcatcccaaactaaactgatcatgtcccaaatactattaatacaatctttcatatttttttctaccaggcccttccacctgcccccatcccagtccagagattgataggtcactgtggcagctttctgattaccttctcatcactgcatctcctctccccaatcacttgtaaatgccactgtcaaagggagttttgcaagacaacactttctcctcacttggattctcccaacaaaggctttcaatgactaccttaaaggcctattagataaagaacaaatgcttttcctaacattcaagctcctgagtcctagctaagggctggatggatggaaatgtcttggccaagttcaagggttgggccaagatggtggccaacattagatttcaagcatgaaggctagggataccagttgtcatgagttaattgtgcatgggcagggctgttaatggtcaaaaaaagagtcaagtcttgggaaagaatataattgtcaacatttgagcataaagaacaacctcccaaagcagaatcattccagaaatggaaaggaacacagagatgagaggcaggagggtgggcttcagaaacaaggacagaagccaaagttggggccaaagaggcccttcccatgggcagatcagaagtgtgcttgctcagagcccaggaggctgaggttgggcaacatagtgaatgtgaagccaactctgtggagcacttgctccccacacagtgctcactcttctccatagaataaggcaagctgtagctctgaaaaagtcaagagtgtagcttctggaaaattaacctaaaagtatagaagccacccaaagcatagaaagcatccattcatcaactgatgaatggatagacaaaatgttgtatatccaatacaatggaatattattcagccataaaaaggaatgaagtatgttgcatattgcaacatgataataccttgaaagcattttatgccaagtgaaagaagccagaaacaaaaggccacatattgtaagatttcatttatataaaatgtccagcatatgcagatctctagagacagaaagtatcacagattggtgattgcttagggctgggaagattgggaggctaatgggtaataattaagaggtatggggtttccttttggggtaataaaaatgttgtaaaattgatggtggatgaatgtacaactctatactaaaacacattgaattatacactgtaaatggtaaattgtatgttatatgaattatatctcaataaagctgctttttaacaaaggtggcagttggttcaaagtagacttcaattctacacgaccaaagaaagaatcaaaaaataagtcagcaaggaaaaagtgaattttataacacctctatcctggcagcttgtggaaagcccaaagacgtgctatgtaatcttttctgtctccattgcgagattattttcttttctctgccccttggtgctacctctgcagcttatacatatttctgtttctccttcaatagcaatagattataactgttggccaccctggctgcttccctactgcacactgtggctctcagaggactgagactgttccctattggctcctatatctctagtccctggcacaagattgatgctgactaaataactgttgaattgatattaatgttataaatcctggtcccttttatctaaaaaatcttactatctgatgagaaactagtaacactagttgctgatgaggagaactcagtagttagggagagggatgggagagaagcattttgcacaccctttagtacctctggaatttcatgtatgtcaatatgtcaccttctccccagataaattaatttaatgttttaaattgtttaaaaatatatcatttattagcaaagacacagaattcatgcatttgacaaaacagagaactgtagaatgtgacaaagctctcaggagagcagactcagacagcaaactcttcagtgggaggcccaggggagtggaaatcaaagtccccaggagaccagagtggagagaattatagctctcttctcataattctaaggaagcaattgtagttctccattcattcttggtaatgacatcagggtttctctgccagcctcaacaatctcaccactgccagtctcaaggctgatacagattcatccacatcatgtggcattcacatccttgctgccatgcccacctgtccactcaggaggacagctgctgcagccagaaactgggagagaagacctcattgctgggcagaattactcactaactagtacagcatacgaagaccaccctcgccacacaaggagaggcacacctggaagcactggaagagaggctaacctcgtcccccatgccctttcctcctttctttgaaggtttttcccctctcttgggaccacttatgcaccttaagacccctggaccctcatgctgcacctcattgtccctaagcactgacgcacatcacagtgagaaaatagaaaataatgggacccaaatgtccccaaaagacaccagccctcacagggagccagcacctggttggggtacactttgaaatggcctgtagatgtctcagcctctgcctcctccaagtaagcaccctgaaagcagctctgcaactcctcaccattcatcaccagcccccagcatagtcccggtacatgacaggcagtatttgttgtttagctaacaatgaatgagcatgtagtagtgccatgcactgttgcagttcatttaatcctgacatcagccttaagaggcaaatgctattagtcccattttacaagtaagtcacagagaacttgaaatcacttgcccaagagcccacagctactaagtgacagaaccaggacacaaactcaatcggctacagaattctttagcttaactgaaatgctcatgactcatacaagagatattgaaagtgtgtgtgtgtcagggtgaaggtgggcaggggcaggggtagaaggaagaaagagaaagacaagaaaagaagggtggtaggcagggagggacagaggaggagaaaaagtgaggtggatggaagggaggccactaggtcccgggcacaggctttccaccttgagaggcagcaactctatacggtcagtaccctacagtccagagactgacccaggttgaacaaactctcaagtgactgatgaataagccagaatatcaatcagtttattagtttcagagagaactattacttccaagaaaaccagagtctcacgtccattggtgggaggtcaatgtacatgggaaaaggatcagcctcatctgaagcttgcgtggaaagcaaggactcggtgccagagagccacaggatgatgttaatggcttgtgtcagtgagttatgattgtctggtgctccctgctcctcctagacccatctgtcaagcagagcggatgtttctgcagccagtcgggaccccttgctttggacaatgccggaaaaacactgacaaattactgctccgtggcatccccttcctctagaccatgcacagaccaccccactttggttaatacatttgtttcccagacgaggcacattgtgattgattagatttcacaattgattaggtttcacaatcccagatgtttaacttcattatgcatggattcttcttactaacataatctcagaggacaaccatgttctgaaaaataaaaaggggaaaaaaacaggacttattctcaggcctgttgctgctctcatcctctaagttggctctttgtctcagaaaagggtccagtttgtgtcttcacagtgtgaacaaattgggaactggttgggagggggacatgatgggatgggatgaaaaccaagcctggattaaggaggctgactccactgcagaggaatgagcttacagctcaaaaaactgtgatgctactctagttagtctaatttaatcctagctgcttgtgaaggccatgcataggctgcctagcttatcaaatttctctggtacagtacaagaccttataaccagtagcagaattttttggtgtcactactaaaagtcatatttaaatttaccaagcaccttctacattgtagatgttgtgtcaaactcttacacgcatgtgttagttaaccattgctgtgtaacaaattatcttccacgattcagcgtcttaaaacaacatgcatcgactgtcttgcagtttctgtgggtccaggcacagcctagctgggtcctctggctctcacaatgctgcagtctcatcttgaggctggactgggaaagactcacttccaagctcatgtccatgattattgtaaagatttcttccctcttgaattgttggactgagagttctcctcctcagggagcccccatgagcttttggctggagacctccacacttccttactatgtgcccttctccatagaccatctcataccatggcagcttgcctcattagactgagcaagtgagagggcaaggaacagtaccagtgacagaaagagagagagagagaaggagaacgctagcaagaaagaagtcacagactacagacttaaccatggaagtaacaaccccttacttcgctctattccatttgttagaatcaagtcactaggtcccatgcacactcaacgggatgggatacagaggggataaatactaggaggtggggattgttgggagccagtcagaagcacatgacctcctcaaggcaaccctgtgagatagatgctattcctgttctatgaattttccagatgtggaagctcagagaggttaagtcagttgtccaaagtcacatagcttgctgatggtggaatcagatctcacatacgaatctgattttataatcattcactgagttcagcttggtcaagtgattttcccatagtggtcccaatatcctatcaaaagaaggtcactcattctgtcaatgagtaaggttggttgcctctaatttagcatgagactaatttgaagggagaccaatttttggtggccactagcatcaggaccaagatctgggcctttccaattctggactttgaatctcagacttgctgcagagatgtcctgtgctcctcctccaacctggctctgtcaacacaaggcagtacctcactcttggtcactgcctggtttcccttccctattattgtagctgatgtttgtatatacagtattccccttagcaacctgcccaatgacataaccctgtagcaccaggcatagttcaataatgtctcataaacacttattaaacactactttgtaccatgaattgagtgatgcagagaaaaatcagacattgcacctatcctcaagacagtcacaaagtgtcttgattctagcattgtgccatccaatacagtagctactggttacatctggctaccaagtacttgcaatgtggctggtctgaaatgagataagttgtcactctaaaataacagtggatttcaaagacatatgaaaaaagtaaaaatatctcatcaatatttttatattgattgtaaaacaataatatttggggtatgttgaattaaataaaatatactattgaaattcatttcacttctttttagtttttttaatgtgtaatgtggcattccacatcggactcacatttgtggctcttgtcacatttcccttggaccaccctggtctagaggcagggagtcacgtgatacccacaattcccatttattgagggttcaccctgtgcctgtgttccacatactctctctctacatggaacacaagttatttcatctagtcctcataataaactcatgcagtagacatcattatttcctcttaccactaaagcggaggctcggtggactgaagcaccttgcctacagccacacagtaagtgggtgagcaagactgagaagctatggggctccagagtccatcagaaagaggaatacacacctgtgctgttcagagtgatggacgctggaatggagccacatggggaacccaggagaaagcatccaactccaccttggaaggccaaggaagacctccagatagacatgacgcttaagctgagtaagcccagaataaagatatccacgaagccaacaggcaggagagagctttcccagcagaggaagcagctggcgtgaaaccccagaagcatgaaactgcgtggtgcattcagggaacagtgtgggtttgacataagaaagtggagggagataagacgagcaacataagcagaaactttgcagtaaaagaactacacaccgtgcagaggggtttggactttgtcctgttgggtcagtagtctcaactctggccgcgcattggaatcaccaggagaactttttaaaataccaatgcccaggacccatgtcaaagcaattaaatcggaagatcataggagatggtgatgaggtggcccaggctccagaatttgttaaatactctctccagcgattctaatgtgtggctgggttgagaagctcttcatagtattaggaatttgcggaatagctttaagaaatgaagtcaaatgatcagagttttgtcttaggaagatcattctgagggttgcatcgaaaatgaattattttccattctccagtaactctggaagccgggaaaccaagcgggtttctactgaaatagtccaggtcagggatgctgaggcctgaggccacgtagatgaatggaatggctgtgggggttgaggtgcggagccccctgagagaggcccctgctatggttctgaccacctccagcctcaagcacttccaactgcctcctgcatctctcccactaggtgtcccacagacatctccagctcatcacatcctcattggaattattacattcccccagagcctgttcctgcaggttttcctaaggtttccttcattcccctcatggctccctagaaaccctccacccctccaggtccatcatcaactcctctccctctctcccctcttttcccacatccaatcaatcagcaggtcttgttgcttttatcctcaaagactgtcagaacagctcttccctgtcactccccagcccctctcttattcaggctctttcatttatggcttgaatccttgtgacattccctgtggcaatcgctactggatttggatgtccaaagccatttgaaactctgattcaataggtcgggtgtagggctcaggcatcacacacatgcacacacacacacacacacacacacacgcacacacacaaagagatataatctcccaaagttattctaacttcgttttagatatgtggttctaaaagtatgtccttgtaccagcagcatcaacatacctgggaacttgttagaaatgaaaattcttggacctccaccccaagtctactgaatcagaaccctgggggtaagacccagagagctgtgctttaacaatcccttcaggtcattttgatgcacattcaggttcaagaatcacctatccaaactactcatggaaatctcattcccacttgctaatgattgattttcagtgtgcacataacccagttctggccaatgaaacatgaaagaaaatcttccaggagggcttctggaaaaaaaatgttttctccctgatagaaaaagggagccatattttaaaaaaagctctttctccaatatgtatactttatgtgagtaataggacctgttctcatgtgaggctgtgatgcttggagctatggctgctatcctgggaccatgaggagaaagtggagaggatcacaggaaagctaatccaaaacctgatgttaaactttcaaattaatcaattctggaacttcccaatcttcatatctgatgcaagatcactgtcattcttatttaagccactcttagttatatactttcttacttgcagccaaaagcatcctgacttctatagcctcctgactgttatccatagttccaggctcttcccttcaaatctatcctactgtgagaaactgtgaagggtcttagattttaccctatctacaggctaacaactgagcatgaaccctggtgaaaggcataaaacttcttggtcagaggcaaaatattgtattactcatggtacagcaagcaccatgtttgcatcagttccccttcttctcaagtcacacagggacaacactgtgggcccatgtggtacctacacacccagtgggttgcattacaggagaagaaccccaagccaagggcccaaaaaagcagtaagcagcaaacaacaaataggttctcctcctgtcctcccaggtagggatggttaccttgccctacttagtcacctttatgaccagatacagaactgctcagtatcgagaaagagacaaaccctgcaatctgagacattcagcaaaaaagtgcagggaagttcagagctcatagtgaactgcctttccaacaccgtgtttatcttccagctagagctcccaaatgtccatggctgtagtcacctaagtccttgcctcagataccagcagagtctgagctagcttgagcccttaatcatcccttctcatttctggctgaaacctatcacaccctccaaaaaagactgactatgccccagcggctcaaggatactcaccaggcactttctcttacctccgcacagagtccacttcttgtctggcatcacagttttccagactttcatcttccaccaggcccctcctctcatctgcatctctttgaatttatgcttcagtgacagtctcagtcttgattccccttttggtcctacgtgcccagggttctgcattttccagggcagtccgagtctactttgttctctcaccgccagcaccctggacttccaccagtccagatgagagttcagacaagcggctccctgttgcctcctaagcacataacactcctcactctggaatcaaagccctacatgccctcctccaatttccttctctgaaattatctccaactatccctctacagtctacacactccccagggttcctggactatgtggttttctccatcccatctgttgtttttcccctctagacctttcctcatgatctttgctggatttagaatgtgctcttcctccccactctgctcctggggaaatcctatccctccctcaggcccatctgaaatgaagactttggtaaacctctgtacggttctctccctgctggccaggccctctgcttcttttcaacccaggggctgtgagcttctcttacagttctcatctttccagtcttctgtgacgtcctcccaggctggtctcattcctgctgcaaaataaaagctcacaaaagcagggactacttgatactcccttttgtctccctttctgacctgagtactgttgctagctctgttactaatagtgttctcccctaaatgcgtttgaacaccatgactgctttttcctaactaaagcaaatgagaaagccctgctgtgaactgcatccccgccatgctagtccatttttctgctgccttagataccagaggagggatgaagccttcgtgtcactgaaactgatgtcacttgttgagtccgccaaagggcaaataggcaaaatacaactctataggggaaatatgttgtgattgggggtgtgcaaactacacaatctcccaaacagtgtgctgagaattgattccaggtatatctggatacttcagcccttgcagtagctaggtggggcctggattgggctgagcctagtgggctgtaaaaacatcacttttgtgtatttatgaaaataaaaaggattgaaagcctagctttagggatgtggaattcctagcaccaaagggcctagcatcttgagggtctaatcctgcaaaggtttagactgtttcactcataagcaccaaataaagggaattgtcaatgaaatgaagataagaatgaggagttgagagggggacaggctatgctgaaaaatgtgatgaaagcttgtgtatggattgggactaggatggaatggctcagaagaaacgagatgggcataggtctagcatgaattgtggtaagaacaggaggcaatgggttagagagggagttaatggaatttgcgtgagctggaaatagggtggatggataggggagtaaggctccacccagaaaaacccacctggcttcctcaatgtttcctttcctccatccttcccagtaccctgatggatagctttgcacagataaattttgttcccagcccatgtccaaacaatatcacaaaatcagccctagccagttgtttctgtttacagccctgtctgtgattgatccagctctggaaaagcccatttatcatgaggaaccaaagcttcatggcctactgtctattttgttgctttattccctagcactaaatgggacttcaggacctcccacttgttccagtacccaatgacatgcctatatttccacactcagtttgcccttcccttcagcccctctagctctcagccttcctgggaccttaaataagtcacgcagctcctttcaccaactcttttcttgttctcgttacttctgggctcttctgcctttctatctcgtctccttctctcagcagctcactgtcctttccaatttcagctgaaatcagattccttctcccttgcctttgctttcccacctcccatggcctctcttatcatttattatttaactcagtcaccatattatgtatgcacaagagccatttctgaacatggtcggcatgaaaaaaataggacccaaagcagaagcaaacacctcttccctatcagtctcacagctccattgtcatcctgctccagtcctgagcaaggtccagcgaaacagccagatctggccaacacaccctcaagcccaattaacttcttaggttggacacagggaaaatttccagatggctttttacagatatccttcaatttatgtaagagatgccttcctggaagtggatgtttgaatgaaattccaaatggaatatcaggagggtcaggcacacaggatgtgtggttcagagacccaggttctattcttcttgagatggagtctcgctctgttgcccaggctggagtgcagtggtgcaatctcggctcactgcaacctccacctccagggttcaagcaattccctgcctcagcctcccaagtagctgggattacaggtgcccaccaccacaaccagctaaattttgtgggtttttttttttcttaagtagagacggagtttcaccatcttggccaggctggtcttgaactcctgacctcatgatccacccacctcggcctcccaaagtggtgggattacagacctgagccaccgcgccctggcctccagcttctattctttaatagccctcattaacttacttccagaacttgggcaagacctgtagcttctctagatctcaatttccccatttataaaacaagggagccagactatatttcctcaagtttctttcagtgtgaaaattcaaaaactcctattttacttaatgatccacatgattccattggagatccttcctacagttaaaattcagctctctcctcatcaataggtcattacggagcatgtgctatgctgctgcgcctcattagaagggaatgtagattaacctggtgaagccctccttttatagatgaagagaccagagcccagagaggagaagcacctaatcctggggtcacacagccagtgagaggcagagtcagtctaaaatgtacaagtcctggcctgagactactctttttttcctgtgtggtgttttaagcatgactgcaaatatttttatcctccttccatcaagaggtagatctatgtcccctactttctttttctttttttttttttttttttttgagacggagtctcgctcttgttgcccaggctggagtgcaatggcacaacctcagctcaccgcaacctccacttcccaggttcaagcgattctcctgcctcagcctcccaagtagctgggattacaggcatgtgccatcacacccagttaactttgtatttttagtagagatgaggtttctccatgttggtcaggctggtctcaaactggcaacctcaggtgatccgcccacctcagcctaccaaagtgcttagattacagctgtgagccaccacagcagaccttgtcccctactttttatttgaatgggtccttggcacctcccaccaatagtacatttggaatgaatgctatgtaacttccaaggcagggtgcatagaaggccatacagcttcagcctagctctcaaaggacatttattttctctcagagccttcatgtaagaagtccaatgggttgggtgctgtggctcacgcctgtaatcccagcactttgggaggccgaggtgggtggatcacctcggaggtccggagttcaagaccagcctggccagcatggtgaaaccctgtctctactaaagatacaaaaaaattagcaggatatggtggtgcacacctgtaatcctacttactccggagctgaggtggaaggatctcttgaatcccggaggcggaggttgcagtgaaccaagattaaaacactgcactccagccttgctctgtctcaaaaaaaaaaaaaaaagtctaacaatcctgagaactccatgctctctcagctgagcccacccgtaagccagcccagcccagctgccagacatatgagtgaaaaaactattggaagtggatcctccagcccccagtggttgaaagcacccccattccagtcctcccctgaaagatccacctctgtgcttttttctaacttctgacccacagaatttgggatcacaataaaatagtggttgtttcatgccacaaagctttggagcagttttttacatcgtcatagacaacctgaagaactagtaaactctcatgttggctaatattcttgggctcccttcccccaggtgaccaatgccaggagtgtgtgacttgcagcacatgtgctgaaggtggagagaggtagcctctgcctcctcacactgcacatcccctcacctgcctccagtgtggtcagttcacataggctttcactcctctgcccaggcaaagttctcctctctcctgccacggtcctttgtttatatcgtgagtgcaggcttgtcacacggatagcaaccagattatttatgtttgtcttcactagactacaggctctaaagggacacagctgtattctatgcatttccctgtgctgaggcctagcacctagtgggcgtgaaataaatacgtgtggaatgaaactgtcaaagaccatgtgaccagctggccctgaccccctgctaacaagcagcagacccagaacccctttctggttctcctccaggcagggcacagttgtttcctatctgagcaggctccatttgcttcacatcagcccaagaacagggaatgggaaatgccttgtgctgcaggagggaagacaaagtaagccagagagcacttggccatctggggctgggagcggaagagaatggaaccattctggagagccagacatttgttttgtagttgttgcctttgtgaatgtacatgtcctgaaaccctggttaattttcttgttcaaacattggtttaaaattgctggctctaggagagatactgtccttcagcaggttctgttataaactttgcaactccaaggtctgattcagcagcaagctggaaaagttcctggttgctaagagaccagagagcaaattagcagctcacaaaagacccagctaagaccagtaaaaaataagacaaacgaaaacaaggtaggaaatgggcctcctcaaaatcaaaataaggtaaacaaactggctaggaaaatgtctgattggaaaagacaattataagtattcttcatgctgaagtaaaatgcactataggtagctaaactctatctttgtctttttgtcacttgaagaaaacagcaggggagcccctttctagtcctgaaattccggatctatgagtcagagggaaaaacaaactgtcccagttgataaggaggaaagaaaaaagtgaaataggctgcctcttttatgagctctccctgccaggacggtgaatgggctacctggggtggtggcccagaaacattcctgcaagcaaacaaaagcctccccccaggaaaggtttctgatcactgctggtccaaggctcagccgcaacagagggctctgacccccacaggacttggccagacacttcaagatcccatctggcaatcaagcatgagaattcaggtacttgtaataagaaggggcaaagagaaaagtaccaaataggtcccaggtattaaatatttattttgttaaagtgcctctatagctatgatttttagtaatttcttttctggtcagacaatctagtaaaatattatattaaaattatttttaatcaaaaacagaaaaaagcatgccaatcacttacctctgatggaaattcattctccaagacacacagttttcctaagaacctactgcttagctggacaaaatagtaggaaaatgctccaagtggaaattaccagcctcttgagggaggagcttgaaaatcttaagtgatcacagaaaagtcacagtcatctgggttttggagaccagagaagaaatgaagaagggcaaaaaaaaaaaaaaaaagaaaaaaagaaaaagatggggtgtggggaggaagatggggaaacatggagctacaaattgggagaaaattaaggcagccagtaggcatatgtcagggagctatggcgtgatatgcctaagaactatgtgactgaatagcctccacttatcaatatttgttggacagcaaaaggatttcagaatatgatggatccaacaagcatgaaataatctttaggggaaaaaattacaattccccacatggcagcttccttcagatcttttctgacaatcctgtttgtcagatttctaaatcgcatgcaactgctatattttaggcagagctggtatcttcctggaaaaagaccgtcccaaatattcagtgcccctccctgcaggagaaatagacacctcctttctgatatatgcagctctggccaaatgacttgctttggcccatgaaatgtgagcagaagtcacatgtgtcactttggagtataagttttaagagctagcacgtggttctctggcttttctcttgctgtcacaatgaccagaacatgttccagatagtgccttatccaacaggcttggtccccaagagaagaaagcatggaacagagctgtggctggattgcagtggacacgtagcccagatgaaaaataagttctgttgtggagttacctgcaattgcagcaaaacctagcctatgtgactaatatacatggcccacgggactaaaaggtggccagagttgcccctcgccctcattcacattttctcactagctggccacagtctcaccttgagaggaaagtcattatgctccaggtggctttcttagaattcagatatgttgcctgactgacccaggaaatcagggctggcagccctgctgctgagcgtggttcagtacccaagaaacaggcaaagatggcgcacggagctgagaggagacagaaccatgaacttcgagttggaaatgccaggttggagctggctcaccagttctaatttaacccaaaaagaacaaacaaaaaacaaaacaagcaaacagaaaaaaaaaaaaaaaacactagaccttcttattcctacctttagaactttagagagtgttgatatttaaaaaaaaaaaaaaaaaaaaaaaaaggcaaacaaacaaaaaactgacccccaaagccaaaagaaataacatgtctttattgaagaaatgtccattcttccttcaaagcctctttcccttaacaaacgtggtatgcacagcaaaatggaaaagatgtcagcctccacagtacagaggaggtgagaagatctgcttcccagcacactgtggaaaggcagggcctggagcaaggctgtgacctcagctgcacatctgggtcctaagaccactggagggagctgtgctgagtcaaggttagagagcccttggcaagcagatccccggcaaggcagccaagtcaaagaggaagtttgaacacttaatgggacatcaaatgggattttccctgcaatctcagaacttctgctaaaagccctaaagtggatagcaataagtaaaagtgcccccgcagtctaaaaagaaagtgatcagaggatacctgcaggattttctcaaagatgagtgatccaatcctcccatcccacctccaccaccccaagagaatactagaagatttgcgagtccattgaaataggcgcatttctaagagtagggagttgtcagcctagtaggaaaggctagggtgtttctccatccctccctttccccatgaaggcaggaggaagatgtttctcccatcctcaagtgaggcacaaagatccaagagaacagcagggaggtcaggaggccttcgagagggagagagtgagtccaatacccagctgggtgctggctgagccacagaaaccagtaggctgacatggtgctccccagacaggagcttggggcttgcccttgcccccaggttctggaacagggaggctggcacctgctttttgtccagagaattgtaaaggaatgtaggaagctggctgggctggcttgcagtggcaagtacagagagggcatgaggtgggcatccctctcatctgggccacgtgaccactacggaatgtgtccctactctaggtctgataagacttcctcctaaaagggaagcccaggaactagaggcaaggtgtgggggaaggtggtaaaaagcagactaggccacctctccaaggcagacctagctcaggcttgagctgagggatggggaggggagaagcatagtgctgggtatgagattgaagttttgatttagcccggccacgacctttcaatgcttgaaagtgaggtgaggcagccaaaataaaactagttattataactgaaggtgaccaaaaagctgtgggctgtgcctgaaacaacgtcaagggatggtccagaaataaggaagagaaatgcaacagagagctagaaaacaatagttggagaaaaataaagccacctcctgattgtactccatggagtcacatcggtcaaaaaaccaattacaattggagggaaattcaccagagagagaagtgctgtctagagagtaactatgattggggagaactgcccaaagacattccattctccatctcattagagtatgcattctccagggtgtgaatgctcccaagtgctcccaagggggtggaaattggctggggtgggggtgtgaaaaatcttagatgtttcaaagttttatgaccctccaaagtttaatcctgcccaacaaaatagtatgtaattatttcttaatttatgtttactatacatttatttatcaatacatatcttatctctctataaatttatattattttatgttattatttaaaatagtgtttaggatagggaaaaaatgaaaggaagggaattttttttccttaggggaacaatgctgaagaaaagtctagaaacattgagttagagagaaacacaacattcaacctcaaaccagaactggtgtttggataaaatttttctggctccaagtagaattgctttcactgaatttgttttgatatcctaccttttgagggctttatcctctgcttcacaaggtgtccttttcatagggacccagaagagaacgttctttcaggtttcactgtaaagaaaagcagtgcttcttctggataaatggtttgtttatcttttatgttttatcttttatgagatttgttatgcacatctcaaattagatcaagtttccctctttgcttcagccacaggggagctcagggcaccttttgtaaccactgcaggactgggccatatgcatatctgggactttgccttatctgtgcttttagtatttttctacttttaactttgccccaattccctcaactgtgttttaactctttcctatttcatgtatttttataagccccctacaatcctttgtggaatatgtgggatataaatatgtaaagaggaacactacctctccttccaaagttttctttccgcccactcttattaagtctgtccttatacagttgcttttctttttaactcaatgcacaactaaaaggtattctattgggttttatctttttcttagttttccaggatattaagatcatcttgaaaactgattctgtaacccaacatgtttgccaactttgtgttatccatagtgttgaggaccatacctcccatgtcttcatccaagtcattgataacaatgttgaatggaacagggctaagacagacccctaaggtatgccactagagaccttcttccagccaatatcaatgcactaatcccctttctcttctgatatggttgaaccaacgattagcccaccacatttctgccatctgtcttctggctaagctacttggtcaaacatctctctgaccaaggagcctctgcctacagcattccttagacctgttactcttaatatcgctccccaaaaggaagtaggctgacactggatgccgggaactcaactctactgcaattgtgtggctgccacctctgcactggaaatttgatactggatcccaaaaataagaagcctgagttgccagctgcatgagtaaaatgaatacaccacccagagctatgtgtttccaaatcaaagtctaatgtaggttctcctcaccggtggagcctgggtcacatgactggcaccagctgcaaaaaatactaaaaatctcagttctctggattctgccttggagcagcagttcccatatgtcaggaactctaacaaggattagaatgatgctcaaaaagtgctaagcagtcagacatgacgaatgtccctagagcccaaatggtggggggacatggctgcccaatgagcccaggctccatcctgcagttctcagacccttctccaagctcctaggagaggaaagccagtgggctaaccttggacggggtgctttccagagacagtctcagctagtttgcaaggggtcaggcagtgctgtgaaggctgtcggtgccctcctgatgtcccctcagggcatttgatcccctcctggtgtgcttccacctgagtcagcaggcacctgagtctctgtgtcagaggactgttctcgggcagcctcagccctgggaattcacatcccctaagacaaccctcaatcaatatgattgacaacataaggattaaacattctccagccttctccatgatgaaacaactctgaagtgtgacttacaccattaacagacatcccctgtgggactcttccaaagttaccctcggggacactttgcttcatactcacttctttcccttctttcttccagttccctacgacctctggattttccctgggaacacacttcctaacactttcacacaaacctttgcctcagggtctgcttctggaaaccaacctaaaacaggaaaccatggctgccggaagtccatggtggtaaatcgggaattactagagaaggaatgaagagaagaccccaaacgtgtccgttgtccccctggttggaccccctccagaccaccttggttctgaatgtagaaacttaacctctaaatatctgcccaggccctgccctggtccagaagcagagctggaactcaaaaccagttttgctgaaggtgtgcaccttcccaacatccactggtgagaacatcccagcacactgctctgtaacttccagaattcattcctttcccctttttgaatgtcaagagctcatatgcccatctcatgtcattgagcgcaaatccctcccctataatttatcaaagattgatgacagtgactctgaaatctcatgtcaagtccctcccaggctgcacgacataattcatcagggtcagagccctgagtttatcacagctgctgctaccggctttactgcctcaatgcctgtccttgacttcaatcccctctttgcaatgtttgttctacccttttcaattggaagaccactttccttactggaaaagaaggaggtaaaatcatagttaggcagcacagccctcactttaccttcggcgaatgttaaatcattttctccacgcaaatctttcccttaatttttgcatgtagaacagagaacaatggggttcctcagagagttcagaacccctagctcatttgagacagtagattttcctaccccacttcttacaggtggggccacactgctggattcagcccttgccctctgtcacttaggggacgctgaaggctgttttacaaaatgtgaaccttcatggccacttctgaatcctaagccaactgttttcggacccaggctgcttcttctcctgctgacagctgtcactcctttattcccaaccacctctctacttaagagcctgactaaaagtttttttttttttttttttgagacggagtctcgctctgttgcccaggctggagtgcagtggcatgatctcggctcactgcaacctccgccccccaagttcaagcgattctcctgcctcagcctcccaagtagctgggactacaggagcatgccaccatgcccggctaatttttgtatttttagtagagaccaggtttcactatgttggccaggctggtctcgaactcctgacctcctgatccacccacctcagcctcccaaagtgctgggattacaggcgtgagcgaccgcgcccggcaagagactaaaagttcttaattatagtccctggcccatactttgaattctcttggcttttattcctgagggcaggcctcatgaaatcacccctttccatcactttaagggaaggaccatcctgcctcatcctcaggaagtaacatttttctgcaaggttagccaccaacaattgcctttagggtcatcaaatttttgagactctcaagcccagaagatgccctggttccctggcttctaagcctcttgcgtccctaatttcttactacaacttacccttccattcttgcactatttttttctaatctagctataagagagattcacttagtttctttagctaaatttccatttttcctcttcagctggatcaatgctattttaaaacaacaacaataccaggaagagtaaatgagaatctaacgaaaatagttatctgcagggtgtgaatagaaatgtagaaatgtagcaaaagggctagggatcggagggagacatcttctagtataccgtcttatatatgtttgatttttcaatcatttaaatgtttttacatgtttagaaacaaaattaaattaccaagagcgaaaaaaaactaaacctaaagatgagttttaacaaaagcaaatgaaacctaattctgtatcaaatcatatagaaaaattctaattcaaagaatttgggacacagtaccctgactatacacccttaatggaatatattctaaagagaataaacaccacaaagatgccttaaacctgactgagtaggtttgttcttagtagtataactggtgcagtaactctgaaatgatttgtgtgtgttgtagaatagagaaagttaatgaatatgttggcattttgagaaccaagttctcactgtgagagaaagaacacatgaatagggattgtgggaagggaaggaagaccctggggtgttggatttgaattggaagtatcaaagtaaatacaagatttctttttttgaaaaagtatttgctagctctatccactgaaagagcctagaaataacaatgctccaatggaatgagtgcaccaagcacccagaatttggttttttaatagtgttctccattgaaaggagccaggagccttgggagaaatgactgatccgattctggagcagagacagtacagggtaagcctaggatgtcaggttgcgctaaaaatcaagaaagtgctcaaattctaatggtgacatgtcaaaggagcacgggagccaaactgaaagggctcccaccaggcaaattttggacaatttgagttttaatatttgtaattaattatgacacatggattttttttaagttccccagttcatggtgatattcaaaagggtggggaaactcttcttcatgaaagaatgcctgttaatgaagtagaatgatagaattagacaattaccattttacaacgtagtgagttactcggctaagaatcatcggtgtattctgttaccattgaataaaaggttggtgagatattcatgcagttcaaatataaccccttcagattacttagtaagtaaaaaggggcaagggtgcaatggagaacagtggtggacaccacttaaccaaatgatcaaactcagcatctaataacgggaccaactgacatgaaatggcagccaatttctctacaatagaaatggcacggattcttcaaaaatctcaggaaggaccgagcacagtggctcacgcctgtaatttcagcactttgggaggccaaggcgggtggatcacttgaggtcaaggaattcaagaccagcctgacatagtgaagtgaaactccgtctctactaaaaatacaaaaattagccaggaggtggcgcacgtctgtggtccctgctacacggaaggctgaggcaggagaatcgcttgaacagggaggaggaggctgcaatgagccgagatcatgccactgcactccagcctgggcaacagagtgagaccctgtctcaaaaaaaaaaaaaaaaagaaagaaagaaaaaagaaaagaaaaaagaaagtcaagaagaattttaaaaaatgatctattctagactcaaggataataaagacacatgcaatgcatgatccttgaatcaaggagggaactacaaaggacattgtggggacaatggaggatatttggatgtggatagtatatgaaatagtgctatatcaatattacatttcttgaatgtgatatggtattgtgaaggagagtatctttagaagagatgtgctgtagtgtttaagagaaagtattatgatgtctataacttaaatgattcagattttttagaaatatatatatgctaggtgtggtggctcatgcctgtaatcccagcattttgggaggccgaggcgggcagatcacctaaggtcaggagtttgagaccagcctggccaacatggcaaaaccctgtctggcaaaaccctgtctgtactaaaaatacaaaaattagcccagcatggtagcacatgcctgtaaccccagctactcaggaagctgaggcctgtaaccccagctactcaggaagctgaggcaggagaatcatttgaacctaggaggcagaggatgcagtgagccgagatcacgccattgcactccagcctgagcaacaagagcaaaattccatctcaagaaaaaaaaaaaaaaagaaaaaagaaagaaacatagataaatagatagatagatagatagatagatagatagatagatagatagatagatgatagatagataggcataggcatagatagagagagagagacatggctaatgtaagtgaaacgttccaggtgttcatcgtactcttctttcaactcattcatagatttgaaactttttgaaattaaaaattgaagtaggagaatgctctggcttcacctcaaaccatttaagtcaaaatctctaggggtcagcccaagtttcttttatagcatttctccagaagtgtttactgtgcatccagggttgagaactactggcctacctgattcatgatgatgtccaggccctcagaccctgcctcagcccccaaggaccctgaaaataagtctcttaaaggtcacaggggcatctgagtctccagcaggcccttgcagccctgagtcagtagcccaggctaaggaggagagagtaaagagtcttcatagaagtgtctgcttagcataggaaccctgactgcttttaggtccttctggcttcctcctgccaggcctctcccttctcagaggcccctctgagataaccctcattctgccccttcaggctgcctctgaaaacctcaggcctctcttcctcctcccttgttcataaggcctccagcaagggaccttgcatggcacgccctcaataaatgagtgccaggtgagccgaggtgggctcactcacactgtgcctctctcactgtcaccctcaggggggaggaggaaaagcccatatcaaacatgggcaaagggttttactttgtccaaaaaaaaaaaaaaaagcagaagctgaaggtcaaagaagcaaagagagtgggaaggactctgttctttacaaagaacagagtcatgacacctcacactggacccttgctaggtgtaggtgctgtggccgcactgaatctgtgttatctcataaaatcaacagcctagccttatggggtgggtcatactgtcattgtcacttcacaccatgtgtccccagcatcacacagctggaacctcagcagtctcggaccaaagcccacacctctagccatggtgctagactgcctacataggacttaaggaggagaaggaaagcaagagccaatattgatgaggcgcctactaagatgatcttgttgaattctctctgcagccctgtgaagtcaatcttatcttcttttgatgaagctgagcaaatggactctgagataaagtaatttcattccatcatgttgaacaagcctaaaatgtatcatgatctgcattgtcttctgtatgaatggcaatctctggagttgtgcaacccaggatcaagagtgacttgcccagggctatgctgccagtaagggatggtctctggatttggaagcaaggtctctcagactttggcctccctggaaaagccctgctgtcccctcacccccaccacctcaagtgttctgttaccagacatctctccgcagggatcagaacctcccttctgcagggagaagtgagtcttccactgcgctgccatcaaggaggtgtcagaaccctgagctcttctagacagacctcagctgttgaacatgtgaagaacatgcctttctgcagatgatgaagtgggatgttggggatgagaaagcagaggcagaaaagtctgaggcatgccccccacaattcagcagactgtggggtagtggcactcatagctaggatgaccagctcatcccagttttctcaggactttccttgttttagcattgaaagtcccacatccagggacaaccttcaatcccagtcaagggagatggttaatgtcttggtcagcttgagctgccataacaaaatcccatgatggaataaaacaacagacaaatttctttctcacagttttccaacatcgaggtgctggccaatttggtttctgttgaatgctctctccctggcttgtagaaagcatcttcctagcgtgtgctcatgtgggctttccctggtgtgtgcacatggagaaaaagtaagaaaaagagggagaacaagagacaggaagaaagagagtgcgctcaggagaatgctccaacgtctcttcttaaaggacattaatcctgtcatgggggccctaccctcatgacctcatctaaccctaaatacctccaaaagtctatctccagatacagctacattggggtttcaacatttggattttgggtagacacagttcagtccacagcagttgaataacctacttgcagccaaatccctcttctcaacccctggtccccgagatgcccaaggggagaaggctatctattcttccagaaacccactcagccacaacagctagtagatgaataccttgcactggagtttctggttttttccagattccaggcctaaggaaccctaagtggtgcctggctttcgtttccaaggcagagtctcctaagagtgggctgggtagggagggtgatcctcaaaactcctagttgctatggataaggttctgagagaccacacatctgtacacaaagtcacacccaaatgcttcttttgtgggcctttccagatgccccagtcaagagggagaaaaggcaaggaggctgtgcatagaccagggctagaatcctggctaacactcacagcctgcataacttccccgtgcctcagctttctttcctgtaaaatggggatgcattataagggttagaataaaatgggtttcaagtgtttggcacctagtaattgttcagtaaatggtaatcatctttatttctctcctgcctaccttgcattccctccattccccctcccctacctttcccattttttcattcattcaacaagtacttattgaataactactatgctgtagtcactggggatgcaggagtaaataaaacagtttctccctccaagaaacttacatcacggcctgaaaaaactaaaagaaaaataaatatgaaaataaatatgaaagtgacattatgtgatggttcactttaggtgtcaacttgactgggctaagggatgcccagatctttggtaaaacaggatttgtgggtatgtctgtgagggtgtttctggaagagattagcatttgaattggtagcctaagtaaagaagatccgacctcaccaatctgggcaggtatcacccaatcccttgagagcctggatagagcaaaaaggtggaggaagagcaatgtccctcctctccctgagctgggacaaccatcttctccttcctttgaacattagagctcttgatccttgagccttcagactccaaaacttacaccactatccttccttctccctggtttgtaggcccttggcctcagaactataccactgggtttaccagtgaattattatttaccagtgaattataccactggctttcctgggtctccagcttacagacagcagattgtggaacttctcagcctccaaattgcgtgagccaattcccatgataaatttcctcttatatatacagatggtccccaaccttcaatggatcaacttataatttttcagctttacaatgagtttataggggtgtaaccccatcataagtcaaggagcatctggacttataatggttcgacttttgatttttcaactttacaagaggtttatcaggatattaaatacattttgacttacaatatttttgacttacaatgggtttaccagaatgtaggcctattgtaagccaaggaacagctgcatctaaatatatcctattggttctgcttctctggaggaccctgactaatacagactacgatagaggtgggaatggaggccagaggaggcaggagagtggatgaatctgcagcccagattcatctagaatggataaatggaaagggatgaaagggatggaaaaagatggaagccaagagagaaagagatcagaaacataaattttggaaccatcagagtcaagatagcctttaaagccagaagtagatgagatcaatgagggagcaatggtagacagagagaacctctgaggtctgcagggctccaaccttcagaggttgaggagacaaggaaggacccctaaaaaggggtcacagctagagacaggacattgagggagagggcatcctagaagtccacactgcagaagatctgaggggaaatgggaagagaggtctggagagagcagtgtagacagctcccctacagtggagtgtgtgcctgggagtcggcatcccagctgcaaggagaagccccaaacggtatggccatgtttcttttatctctgggtctccccaacacacagtaggttctcaatcaaaatctactgagttggcatcagttagatgtcctgtttatggctgaggcaaagtctggagatttcccctacctctcaggccctcgctgcaggcctctgacactccagggatagctggcaagcccacaaggcctccctgagggtccttctctctcagaaaatatcagcacatgtgtccagcagggcctttgatggcttcacacaagaggagagtcatgtgtgcattcctggctctctggacaagaaataaatgttcaggcggagagggagaacttggctgaagtggaggagggaattgaaatcactgaacaaaataacagcaacaccaataacaaccatttattgatctcctgttctgtagcagacgctaggacaaatgcagggcatttgttgacattgtctttcatctcagtccagttcagtccatctccagttacctggtgagggaggggctgcaaaccccaccctacaatgagttaccctgctgcctgaggccacatacacagtagctccaaggctgatgttcctcaaccactgtgtgaagatttatcattgaagaaaggagagatggaggtaggaatagcaaaggctaaagacaaagctaccccaagcagcagcatctccttccatgacttcaactccactgacaccaggctgacctgggctttccctttgcctttcccaccatcacctttgctagctggtgggactttcaggccaatgggttacatgtttagaaacaaaattgggcagtgggctggggccagcaaccacagaaccttcctcctcagccattgtcattaagtaggcagagatttcctgaccttgtcagtagccctctattagtccattttcatgctgccaataaaggcatacccaagactgggtaatttattaagaaaatgaggtttaatggactcacagttccacatggctggggaggcctcacagtcatggcagaaggcgagaggcacatcttacgtgacagcaggtaagagaggaagagagccaagtgaaaagggtttccccttataaaatcatcagatctcatgagacttattcactaccatggaacagtatcagggaaacagcccccatgattcaattatttcccactgattccctcccacaacacatgggaattatgggagctacaattcaagatgagatttgggtggggacacagccaaaccatatcaagcccctcagccaacattttcatggtggcagctgctcatgaagtgtaatctaaaaggacataaaaaacattcatacacacatacacacacacatacatacatatacacacacaaacattcatcacacactcaaaaaatctctcccattggctcacctcagcacctgaaattctgccaatttaaggtcctgtggagaccagagtagttgttatgtttatcaatatgtgtatactcactgcacttcagggaagctggagtttaaaggctggaggactaggaccaaagaaagaacagttgtgctggtggagagaaaaggaagtgagacaagctgagccttgccagagaaaaggcagccaggatagtgcagaagagggaaaggtggaggctcccgaagggatggaagccaagcatggaagaggaaaagagtcgggtctttttctgctctcctaagagttctggtttggtatcgtggttgcgagtgtgagatcaaacaaccaggccgggagcagtggctcatgcctgtagtcccaccaggctggtcacctgaggtcaggagttcaagtccagcctggccaacatggcgaaaccccgtctctactacaaatacaaaaattagccaggtatggtggtgggcacctgtaatcccagctactcgggaagctgaggcaggagaattgcttgaacccaggaagtggaggttgcagtgagccaagatcacaccactgcactccagcctgggtgacaagggcaaaactccatctcaaaaaaaagaaagaaaagaaatcaaacaaccaaggcccaaatcccagtggtgtcacttgctaattacgtggcttaggaaattactcaatcctcctatctgcatccttaaaatgggaagaatgacagtacacatcttgaagggtgatcttgaggcttcagtgaggtaatccatgcaaggaccttagcacagttcccagaattgaataaacacacagtaaatgtttaatattattattaatatttaactgaagtctgcggcctgtttccaccatcagctcctccagccatgagttggagtctgccaaggattttagagttcattgattctctggatgtgaatcattgtaaacagatagattggtgtcttctgtttggagacaatatctccccttcttccaatggcagaacatctggtgacttcccaggagataaaagggtggagtacaataaaggccagaaacctggttctccctgagggagcagaatgagaggaataggtcccggtggcatatgctgctttccttgaccttggcacctgttccaagctggcagagtgcagaggagggagcactggggacacagaaattggtgtaactcctacagacagcaatgtgctcatagctcaaaattttaaacgcgtgtccccttgaccctaaattttggtttctaggatttttttttttacagatatgcccccacatacaaaatgatgtaaatgcaaagttattcactgcaggatttgttatgacacagagactgggaaaaaaatctaaatgttcacactttactgaatatattatggtccatccatacaatggaatattatgcaacagtggaaaactgtgaagaaatgtctataaactgattatgaaaagatctccaagatccattgttaagtaaaacagcagggtccagaagaatgtagaaaaagtgagaaaaagtaatatgtattcaatatgcatagactatatattcaatatgtatagaataacaccaaaagaaaactcaagagatgataatattggtctctgaagaagggatccaagaagccaaaagacaagatagtcactgacttttctttcatatattttgaattttaaaatgctgaagacaactaaattttgtttacaagcacgggacttggagtcagacagacccaggttcaaaacccagatccactggctatgtgatgttgggcaggtcacttcagatcactttaatctctttgagctttgtttcccatttgtaaaacaaggatgagaataatacctatatcacagggtggttgtgagcattcactgagatggtatttttaaaaatatcctatgtggagacaggcatggtggctcacacctataatctcagtgactcaagaggctgaggcaggaggatcgcttaagcccaggagctcgaggttgcagtgagccaagatcacaccactgcactccaacatgggcaacagagtgaggctgcctaaaatagaaaacaaaacaaaatggggaggtagctacagcaaagatgacttttaataaatttttgatgaatctgcatttattcccttctatatgcccaggagagcattataaggtaaggttcaggattgccagtagatggaataaagagaaatgaaagtaaatatctatcttacaaggagtggagggtggcaggtccctcagtgcatgtgtgctgaggaattcgcatcactcacatgtgctgaagagtccatccagctcaccgtttataatgccagggtttgcggggggcagtccccatcaccaggtcattggatcctcactgaggaccctatgacatgaacaagctggagactcctggtgccattttacagataagctctcccagggagctgcatgatgggcctaatgttattaatcgaacagacatgagtggagaggcagtaggtcagtgtgaagtgagcataggttctgggaagaaaacaagttctggttggccatttaactgtgctgagcctcagctcctgcagccacaaaagggagatcataacaccagctgcaaaatgttgtgtgaatcagagcttcaggcactgtgaccaagacacgggaaagctcagtcaatggaagctatgattatttgtgtgggattatgattggaggaaggcagtggggctgtgtgcccccaaaagtgccttaaccactcaaaaacagaatctctgccatgaaggagttcacagtctaataagagaaagagacagatcatctctattcaataaagttccccctaaataaaaatatggtttacatcagttagaatgacgatcattaaaaagtcaggaaataacaggtgctagagaggatgtggagaaataggaacacttttacactgttggtgggactgtaaactagttcaaccattgtagaagacaatgtggcgattcctcaagaatctagaactagaaataccatttgacccagccatcccattactgggtatatacccaaaggattataaatcatgctgctataaagacacatgcacacgtatgtttattgcggcactattcacaatagcagactttgaaccaacccaaatgtccatcaatgatagactggattaagaaaatgtggcatatatacaccatggaatactatgcagccataaaaaaggatgagttcatgtcctttgcagggacatggatgaagctggaaaccatcattctcagcaaactatcgcaaggacagaaaaccaaacaccgcatattctcactcataggtgagaattgaacaatgagaacacttggatacaggaaggggaacatcacacaccggggcctgtcatggggtggggagcggggagggacagcattaggagatatacctaatgtaaatgatgagttaatgggtgcagcacaccaacatggcgcatgtatacatatgtaacaaacctgcacgttgtgcaggtgtaccctagaacttaaagtataataaaaaaaaaagaaaagaatgttcaaaaaaaaatacggtttacacaagtgtattcctgtatatcatggtctcattataggtgtagtgccaggtgttcccatcggccatgattaaaaatatcaagaggtgggtgtcaaggagtggaagggtgggaaggccggaagcaaagcagagaagtttgcaaagatccctgcaacgataaatgaagatggggaggagtcaaatggggcctccaaggagcttcctttgcgaggcattggtgaggagggagtgcagtgagctgtgtacgagaggctgaagcagggacctgggcctagggcaccacagcaagcatcttagggagggggctgacaactgcagccccaggtgtgctgataacatcacatgctagtcctactttcctactttatttttcttgcgaaccttaattattccagagactgagtcaacaaacaaccctgaatcataaagtcaaaaggccttcacaaaaggatgctgatattagcacattgtgaacttactctgttgggaatgcgatctttcagaacaacccaggagcagggtactattttcatcccacccttctacagacgaggaagcagactcagaaagattcattcatgtctgaggtcacacagccagccaggggcgaagccaggattcaagccaggtgtgtctgatgaaaacactcctgctcttcctcacttcactgtaggttttgaacatactttttttgctgctgtgaaggaaaataaatgcagatgtggcagcagtagtatatgaatctatgcatgtgataaaacgtcatagaattatgtacaaggcatactaaaaaaaaatgagtacttgcaaaaactggggaaatccgaggaagatctatgatctagttaattgcattgtgccagtgtttgttttctggttttgataatgcactgtaattagtcagatgtcacctttagggcaagctgggagatgagtctacagaagctctctttttgcaatttcttgtgagtctatgcttttttcgaagtagaaatctggaaaaaatacatgtagaaatctcctgttgaaaatacaaacagggccagagtaggaccaaggagactcaacagctcctagtaagtaaagaacagcaccagggcattaccagggcagtaggagccttcattccaaacgttaagaattacaaaatgatacagctgcccccttacttacaggactcttgtatagctttattttagggtaacccaagttttccagattcacctggctacagggggggctcacctttacagatatcactcatgtttcaccaatctttcccctccttgctatgacagagcttccagcccaccccaaacctcacccacccagtcactgctggggccctctggaggtgtctcacacaagcctactggccagatgctgtagtctgctgctcacctgctaccctgtctgcaggtgccctctgtgcccagaaattccagggtgttgcgtcagcagggcccctgtgccaggcacagaggtgactagggtctgtgcccaagaatggcctctggatcttagcaaaccccaacccaattccactggactcccctggcctgaagcttctctgcattccacacagaaagtgggtggatgcccactgaaggtcaatcttgattgcctggcaccaaagcagggcagcatatgtccaacagagccctcatgaaaactgctcccaaatcctccactctgaggtttagagatgtgtgcaaggttttgaaacacaaatgcagttacagtaagagctaacatttactgagcatttactatgtgccagaccaagcaattcacatgggtaaacttgtctaattctgatagataggtaagctgctgccacaaagagacccatcaataataacccagtggcttaaagaagatagaaatgtagttctctctcacataatctgagggagtccccctggtcagcagcagctttgcttcaggcagagtccacggcccaggttctttccatcttgtttctctgccatcccccaaaacgtcctcagcctcatggtggcagctgggtcattgccatgcctgtttgcagaccaggaggagagaggcagcaggcacgaggcatgctgatcgccccacatcactgggcctgggactctcatgcaccactccactcacattctgctaatgagaacattctgcaggtgagaacttagttacacaggctcacctaactgtagggagtctggggagatggggatatgtgtgcccgagcaattcttttacagtgaaagaagagaaaatgtgttctggtggaccattgtccctccaccacacttcctcacaggtatgaccaaagatgttcagaatggttaaatgcttgccctaggtaaaaactatctaatctgataagttaattttaaccagtgaagtagacctggacccctttcagataaaatatgcgttttgtgtgttttaatagggatccaatggagatgcaaaacttaacccagaagcatagctctagcgggagatacagggtcgggggtttggcagggctttttgagtggcatcatagtccgggctttagaacggggagtcttgaatgagtccaggtccttcatatgggaaaaccactaaaaatctcagccctcagctctgagacagaatccagggtgataatggatgtggcacagctagtgagctgcaagtggctgtcacatgtagggggttattttttatctaaggggatctgcacatcccaccaccaaagctgccttttgggaaggtaacaggtgaccctgtccaaggtctgggctgaggatgaacaagtttccaaaggtgagctgcaaggagcttgacaggagtgtgtgtgtgtatctgtgtgcatgtttgtgttcgtgtgcacacatttgtgtgcatgtgtgtgtatatgtgcaaatgcacacgagcagcttcagccagctgagcagccagtcatttattcatatggatgacttgatttttgattgagttaacaagtacttattaaacacagttttgcaaaggcctgcagtaaattggaagctatacaggaaccctataagtttttacaaccctgcattcttcaaatattggaataatataaaagataagtagggagtaagaggaaggaagagcaaacactagagaaggaggagccatgggaaagtgggttagaagagaaggaggagggttggttgtccttctggtttcgaagcaccagtgggtccattcaccaatgaatacaaaccaacctattgtgcaaattattaaactacatcatctgtcctagtctgagctaatattcactacaatggctcatgttgctgagtgcttactaagctccaggcactatactaagtgttttatatattctatctcatttaaccctgactaccctgaggactggcactattattgtggctctgttattagcctattttatgggtgcagaaatgaaggcagacagatgttaagcaactgactcaaggtcaacagctagtaaactgcagactcaggcctgtctgattcctaacctaaccaccatgtctaacacttgttgcccataggcctcagtctcctcgtttgtgaaatggaaccactacatccagctttgcttgccctatgggctgttgcaaggatccactgagaagtgattgccaaggtgcactgtgaacttacaaaacctaatgtaaaagaatcaaaccacattgctccaagttttgctaagatgaatctaccttaggatcatctagagaataaaacagttactagcaaccaagattaaattaagcctcctctgtttggaaacaactttagaggaaggatgttgttgatttgcctggcagagaatggttccaagcctaagagctcacagttgtttttatcccaaccgccttatcagaatatttaggaatcaataatgtagtggcatgctctgaggattctcaagaagtcctatggcgagccccacatgcagaaaaactaaaaacccctggtcaataatcaacaccaacttgccagccattgactgggtcactgtggaagtggatcctccagccccagtcaaaccttcagatgactgctgcctcatggagtccctgaaccaggaactgctcctgactccttgagccacagacacagtgagagattataaatgactactgtgtgaggccactaagttggaggggttggtaatttgtaatacagcaatagataattcatacagcacctatgataccttgtgacttaagtacaaggttattgggtattaaccaaaattctagttttcaagcaagagaaactattctggtacatgtaagccaaaggggaattttcagggagggcgtcagggctcatcaaatccaagaaaagactggagactcaagtgtaggatcctctggcaacagaactccagctccagttcagggagaggaacagccaggtttccacacctccatggctccagagagccactaatcattccacacatcttgatttagtccgttcagactgccataaagaataccaaagactgggtggctcaaacagcaaacatttggttctcacagttctggaggatgggaagtccaagatcaaggttctgacagatatggtggctggtgagggcccttttcctggttctcagaccaccatcttctcattgtatgctcatgtggtaagaagcagagagaaaagaagcaagttctcctgtgtctcttcttataagggcactaatgccattcatgaaggctccaccttcatgacctaattacctcccaaaggccccacttctgaatagcatcttattgagggttaggattttaacaaatgaattttgggggcacacaaacattcaatccatagcacaacctccgtgtactcactgaggattcagtgtctagagtgacagagacattgatcatgttccagccccctgactgcaccaagggtgagagaaagcatctgccccttggtattatttccctctgagacaaatcccactagggaaagatgattcttgaaagcaagtcatggtgcttttagagaaggggatgggatgctctgcagccaacatcaataaatgcccagccagtggtcattagatggtgttacaaagaagaaggccttgaataatactgaaccaggctacgtgtaggctgtgggctttatagtcattaatcctcacaataatcttaaaaggaggatgatattatccccgtcatccagacaaggaggcagaacctcagatacattaagtaacttgccagaatccacgtggaaagtgatgaagctggcttctaagttaaagtctatggggttccagagtccttacttgtcccacataaccaggcttccaagaagggcctcaagggaatggaaccacattcttgctttgatgaagtcaaataaattaaaaagagtttattaagggaaagagacagagactgaagtaaagggttcacctgatcttctcccaaggaagaatgtgcctgagtcatatctgactggcttgacccagaaagaagagggtagtcacaggcagaaaggaaggacaacacaggcacacagagacgggcggtctccagaactcaaaacttcccaagggtttacaccctgtgtactgaacatggtccgcttctgccacctagccacagatggtctcctcagccacagcacaagaagcccaactgtggtgaaagcctgtgggtgggtatgcagcaagcacaagccacatgtaaaggctttcctggtaaatttccaagatgaccaatgccactgagtcctcttctctgtcatgtgccttcttcatatttatccgagattcccagggacaggatggccagctcctcctttagattagggagggtgggtccttccccacccccatctatactctctgccccactaaagaacttttctataatcccatcttcaccatactcagcatttgccaaatattattcttcattttctaattgtgtcttttctagtttgtttggaaatgaaatctggtttcacctgaaggttgagagctaatatgaagcatattcctgcccttgggctaatatctttatgacatcatgacactaaccagctagaactgacttagtttttgttggccagaagccataacatctctgccaacaagaaactagcataggctggattaaagtcagcatgagaaagattacctgaagataagaaaataaatgaaggcccaccatgcttctaagcacatagtaaatagtcaaatatgtgcagaggagatgcataaacatatctgtgcaaggctttcaaaaggatcaggaagacaggtctcacaaaaaaagcatttccaggctttgtattttacagaccaatatttttgtgttttgttttttattttggggaggaaaatccacacaggattattatctttttactttaccaagtagagacattttaataaagctttaccatcctttcataagataatagacctgttaacacaagccaagtatgaagtataatcacagaataaaggacagtctttccagggaaaaatcatcggcacactggatacgggtctttgttttacactatatagtccctctctggctagtttaagcacaaacaatatattatggagcccagatagatagttcacaaatcactggaaaggctgtagggatatactccaagttgaattccatattaacaccccaaactatgccacgtaacttaccactgagggagctgctgccacagccgctgaccactctagctcctcaaaatgagcaccagctctgtgccctgttcagctccctccattattccaaattacccctccatattccaaatcaaagtcctgcatgagtcccagctgattggctgaacctaagcatatctagatccccatctgccaaggagtctgggaaacgtagttttagttttcagcctctgcagtacagggaggcacaggggctggagaaggcatggagtgaaccagttagccactgttggtgagctttttgtcagaccacagcacttctaaaacatgtcaaggtctaagcctgggttacagaatcacatttgggtgtactggcatgagagccatcctaaggaatgtgtgcagtcacgctttattgagaagattctgaaggtcagtggtcttacacaggcaccttatcaaggttctgacagatatggtgtctagtgagggccctcttcctggttctcagaccaccatcttctcattgtgtgcgcccatgtgataaaaagcagacagaaaggaagcaagctctcctgtgtctcttcttataagggtgctaatgccattcatgagggctccaccttcatgacctaattacctcctaaaggccccacttcctaataccatcttattgagggttaggattttaacatatgaattttaggggcatagaaacattcaatccatagtacatcctcagtctactctgctgccagaaccttgatatggcacctactgagtgaatggctgttcttaagaagggaatttgctgcctgaggctacagcatgaccacactctgactgtagtagacatctgtcatatttgtggcttctcatcaacttttgagtagctttcccgtatctggggatattctcatgtaataagtctcatctccctaatattgaagtcagagatcgagtcagagttcagagcgttcaggtgtctttgcagctaagattcagggatgtggtctgagctctcacaacccaaggcctccactagagatttgattcagaagtgagtagcataaagagcaggcagtgcacggagcttctgtttttgctggcatggaaggcagcagaggccttagctttcagaagtggtggtgaggggccgggcacagtggctcacgcctgtattcccagcactttgggaggccgacgggggccaatcacgaggtcaagagagcaagaccatcctggccaacatggtgaaaccccgtctctactaaaaatacaaaaagaaattagccaggcgtggtggcgggcacctgtagtcccagctactcagaaggctgaggtagcagaatggcgtgaacccgggaggtggagcttgcagtgagccgagatcgcaccactgcactccagcctgggtgacagagcaagactccatctcaaaaaaaaaaaaaaaaaatgtggtggtgaggtctggttcctgcctcagaagtagcatcagtggtggtggcaagagtggctgcaataaagtcaagttcctggtgtccagtgctcagtagcagcagccatagtaataccagtttccctccatgatctagccctacagcacagtttagggcattgttcttggaaactttaccccaaatctatttctccaccctccaaatgattgtttgtccttcagtttcctttattaaatcccatctgcctcaactagccagagtgaatcctgttgtcagcaaccaacaacccacttgatgtgctagataagccaggaacactgaccctgaatctactgcctctacaccaggctgcagtgtgaaccatttctgcaacagagagtatcggcctgaacctcatctcccattgccttcttgagtcaggtacaaagaaggatgggaggaaagcgtacttccttctgactcccagctttccaggagctcctacagaacaagaatgtttcttcttcactggattgttatcaccaacaatttgtgcagggcttagcacagagtaggtattcagcaaatgtttgacgaattaataaataagtgaatggtaaaaacactataaagttatacccagctggattcctaacccagatctgtgctgtccattaacagtacccactagccacacatggccactaaacaactgaaatgtggctagtgcaattgaggaactgaatttttattttatttcagtgaactaaaatttaaaaactgatacctaatcccatttttggaaaacttttggctcatttgtgtatgtaaatgtacattttagctataaattgtataaaagctgaatacagatgaaatctttccaatgaaaaattagcatacaaattgagatgtggtgtaattgcaaagtatacaccagattccaaataatataaaaaagaatgtaaaatatactattaatgttatattgattacatgtggaaataatattctgaatatattaggttaaatgaaacattaaagttgacttcacctatttctatttacaatttttgatgtgactactagaaagtgtaaaattatatatgtggctttcattgaatttctgttagcacagatctgaacattagcataaatattgctcagtggtcaaaggggatgccaaggacacacatttcctctgagcactagaggctccaaccccacagacctaggcccaaccttaccctttcatttccccatcgcctttccccagactccaaatccagcaggaggaagtgtagacgtgggcctctgcaacatgtgaaaaagcagaaatcacaaacgcagtgtttttcagcaggtgatttaggcaactcttcatcagggaaagggctggaagtaaggccacaagcagtgatcaattgtttgctatttgaaggcaattcaaaaagaaaaaaaaatccccaagtgaacgttccttgggtgaccagtgtgccacctctgcataagtctatgaaatcaaaggccctgggacagcctctaatatggtagcttcattccaaggaagagtttaaagcacaaagaagagctgttctagttagtatgagtcagggctaaatgttaagtctcctgatgctcactggggcacaccatctctcagcattaggtgccaatacataacatgccaaatgggtttgatgtgagaaaggaagtgtctgccttataggaatcacttggcctgcatctaccccaggatttccaagcctccctttgccagcactggaaacgcattttgagaaattggagttggggccagaaagcattctattcccatcactggaatctgtgtggcttctatttgcaactccagtagatgtgaaactcttaaaatgattttttccagggtaggaaggaacacaatgatgtctttggctaaacagtgccgggctactgcacagttcaatcctgagctaagtgaagggggaaaagtccggggcactaatctggcgtgactggcagcacccgatggggtaaggaggacagatgagaagggtaggagaggactggtggggataggggaacagggaagggatggaaaggcctgcttctgaaggcttgcatctaacagaaaaggaagggaacctccctgacttaccatgcgggacccaggtaattttcatactggaagcacaatctacaaaatgcttccctccaacccatccccataggtacaattttaccaaataaaatcattcatactcacatccaaatttgccaatctgagcaaaatatagttagtaacaaaggaaggcaattttcatattttatcattcatcatagaaaaaaagctttaatattttttaattaaatacagaagaaaattgtgttgccagagagattgtttgcctgcctttgaacaaattaacaacacctgtttgcaaacaaaagaatttccagaatggagtcaaaccctttattctctgttcaggacccagcccattcatgtcttttgtatacagtatcaaacacatagtaggtgctgaataagtatctgctgactgaatggggtgcctcttttatccctatcctttatttcccaaccctaaactggatcttgatccatggggaaaatatccccacccatccattcctagagtagccctgtctctttcaacagtctttgatacataacattggtttagagacatatgcctgaagggaaaagagggagggtttcaggcagagaaagaaacacacaaagacagggcacagagactaggcagaaacaaaaagatctaagacagagagagagagtaactgaaacacaggtgcagagcgggaacaactgtgggagacagggacagaaaaaccaagtcagagaaacttaaaacgcacaccattggagataaagagataaaagggctgggccagaatgatcatcttgaagtttctactcagctttaatgttttctgatagagaaaatggcagagagagaggaagacacggcctaagcaggaggataaagagacaaaggaagttagtagaggcagaggcagccagccaggcgtgcctagccgggaagcctggtcctaccccggcctcacacccacggggatgggctcccatgcccactttcggctcctaccttaagtccagccaccctcttcccctacccgcccctaaagatctccaaaccactcggcaaatcaaatcctctctccccaacatcctccgtgaagcattctcgctgctccagcccgcactcagctcttcccctctcaactcctaaagccacacccacctcccctaaccacagggcagggctgttttcgagtttgcccttggctcctatgagcacatcttgactcctgcaaaagaactgtgtgcttgtcagggctccagaccctacctcctatattccagtattcttcatgacaccagcccaatgcccggtcttcctaagtgctcagtgaatactttagggcctgaccggccctaaagtgcacgcggggaccgtggccgtcccctggtcagtttggcaggctggccacgctgaggccatctcctgggctcctgcgccctctgccggccaggaggggacccgcacgcgggacagctcgcggccggaagggcgcgcctgctgctgggaggctggcgaggacgcgggcggccctggcaccgtccgagggttctgggaagggtggtgggcacagccaggaacagctgctgtgttcctcttaggcgtaggagaacaacccctctcgcccctacacctcctccggccctgcccgctgggcgctcagagcttctcgtccagctccaggccctggttatcccgggcgcccccgcgctcggggcctgggctgccgccgtgtgtcccactcaggtagttctggatggcggaggcgcagtctagccgctccatgacggtcatgaggtagtgcagctcctgcaggctgccgttctgctcctcaaacaactccaggatggccgctgcggggctgcgctggcaggacaggaacctggcccgaggtaggggaggaagagaagggtgtaggagcagggaggggctccccccctgctgcaggctccctgggctgcgcagcgcaaggtccgtcccttccccatcctgtagcttttgtccttgtcctgctcttgcctgccttccagggcacaggaggtgggaagccccagggctttgaaacttgagattgtcctggcttggaggccaactctgacccctactcctctctaggcttcagtttcctcttattaagatgagggcttagacaagaggacctctaagtttgctacagttctgatgttctgtaattgccttctctacctcccccactccaaatacacccctagcctccccctagcctcctaactccctccttcctccctctctcctaggccacaacatcctgctcactactaaggaaacagttgctgtaaaccatggctttttatcacgactctcccgtccactaaaaccttccagagtctctcacctcctaaccagcccacgctccatgagcctttctggctcatccagcacctggccttgccctgtctttatgctttctctcctttctcccatcctgaacccccttagctcaggcctctctctttctcgccttgcacacactacacccacagccacctctgctactccccaaaacaaaatggctgatctcttccccatcacttcctccctgaagccctttctagttcacccctcccaggtggaagagaacattctgcatccctcagttcagacttctggtcataacgcccgcagttcattattattcttgcttcagctgttttctgtctctcttcaatgtgttatacaatactggattcttacaggaaggcacaaggaacacttgcctttatttttcaagctctctgaaccctttactagtgtgtgcgctcctaggcgccgggaccatgcctcattcatcttgtatcatagtgcttagcacagtttccagggcataataggtacttgataaatgtttaaatgaatgatttaaaaatccaccctgtagtttgcagaccagcctggccaacctggtgaaaccccgtctgtactaaaaataaaaaattagctggacatggtggcgtgtgcctgtaatcccagctactcgggaggctgaggcaggagaattacttgaacccgggagatggaggttgcagtgagccaagattgcgccattgcactccagcctgggcgacagagcaagactccgtctcaaataatgataataataataaataaaaatccaccctgttttcagggtccagctctagccccatcaccaggataaagtcttccctgaccgctgcactcatagtgtagtttctggagcttagctcagtattctcctgctttctgagttccttgacagggatcatgactgcactgtcaccattattgataacatttattgaattaacaagtgtcaggcacccagctacatgctttacacacattatcctataatctgtcttgctcctcctcagggcatagcatggcaagcactcaacatgtaccaaataacttccatgttaatggattcactgttaaatgttaattgagcacctactatgcaccaggcatcattctaggtactgatgatacagtgattaatagagctgcccttttatgggaaatagggtggacagtagccattctctgacttttaagtcactcccttgcctgtgatccagtctccagagtgtcctgaggaaccccattccagcccaccctcctctaccatccacagacctcacccctcttcctaccggatcttcatgccgcaaagccccaggtgggaggccagtctgcgccagtcattgccggtgatgctgtttggctccaataacatccgcagctgctcaaagagctctgggggcagccttaggcagggaaaagggtgttcttggaagaaagggacaaacagacccactctggttctcccatatgcaccctaaatgctgtagtcaccctgtgggtgccagggtaggaacccaacatcccccaggcagcagcccaagcaacccccgtctcacctattgcatgggggcggctgggaaacaggtggtggcgctgcccaggattcctcctctgatgcctggaatctgaggatttccatatacttggtctccaagccctgagtcaacacagggcagggaacacacttaggggtcacaagccatccccctgagtaagaagctggagtcctacctccattcctcatgtctctccttcagtctgtcactcagagccaccttaccaggagatacaaccctgctccacccagcaccctctacccactgtctccctgtgacttcagaaccgcaccttcagccttatgtttgcccctgagctctttgggaactgggacatgaagaccagagtgcagcctgagccaccaggggaagtcctgggtggggccgtggagcagtgggaggtcatccaaccatagagacactgatctcagccatatgtgtaccttcctccattccaaccttcccttcctcttctccaagtgacaacagggtatctgcctgccctccactaaggtgccactatggttccccaaagactctcaactccgatttcttcgcatcttcccttggtgcagcaggagaggagagatacctaactcccagcctgcctactcaagaccctcttcctggtcacttcccacactgaaaatacaaaacatcatctctcaaatcccacactgaagataccaaacatcatctctcaaatgtagacaatcagcctagaaagaaaccatatcaacttgatgccccagttctctgagttgggagaaggggttaaactagggtttggttcttttagcttcctgctggattcatccaccgatagacaaggagagtcagggatgagggtaacttggagcccagatgatctcagcccctcaaagagctggtatgggggctctatggaaagtgccatctttacctatgtgattaagaccatagttactgggcaccagaccctgtgcccactttgcctaggatttcccccaggccctgcccttcctctgcccctcagctccaactcacatcctggaaggtgtgcatggtgacaatgatctcattggttagtgctgaacagtcctcattctcatcggctataaagagaaggtgacagcgtggccagtgagtgaggaaacggcctggggtaagagcaggagaaggtaagggactctatagtaagacttgggaaatctgaggaagctggggtccaacactccatttttctctctgcaaagatctgtgtggctcctggcctttcagggaaggtctgtgtgcatggctgcatgggggtctgcagagctccagggttactgggagggaaggagaggagacaggatgggaaaagagaggggaggaggtacacacagggctcccggactacctgcttttctccggaagcagaaggagcggaaggggcactttccatgccagatgtggagatggggaaccagctggcaactgctgtcatccacattctcccaacctggtgagtaggcagacagcagagggcctcagagagtggggccttaaacaagtattgaagggggctgtggggaggcatgaggacagaacaaaggcaggagggtctcaagggaatgggaatccccagagcctgggctgggaccccaagagggcccttgcactataaaagccttccatcctttcctgcttctgtggggtataacccctctccttcccacctgccacctggcatcaccctgtccaaggagtgagtggcaagggctcagtagacagcagagtggtcaaagccctgggggctccatgaggctactgctggcccagaggtcacaaacagacttggggcctggtgtggtggctcacacctataatcccaacactttcagaggccgagacgggtagattacttgaggtcaggggttcgagaccagcctggacaacatgatgaaaccccgtctctaccaaaaatacaaaaaaattagccaggcatggtggtgggcacctgtaattgcagctactcaggagactgaggcaggagaataacttgaacccaggaggcggaggttgctgtgagccaagatcaagccactgcactccggcctgggcaacagagcgaaactccatctcgggaaaaaaaaagagagagagacttgggatccccagatctccagatgtccaggggaggcccagaacccttcattcctgtggggctcccgatcatcctatcccacaggccactgcctccctcaccctctgagatgtacgtgagcttcaggcactggtcgcccctagccccattgaagtcgaagagctggcagggcccacgcaggcgcccaccatggggctgctcgttggtcagtgcccactgcagggcgcagggcgtgttgttgaggaagtagatacgcagttgcagatgggactgtcctggcaccagcggtgagcagaatacggccagctgcagccatttgcgggcttcgcgccccacaggtgcctccagcacacaggtgtagaggctgcagagggagccagtggcaggcactaatgtgcagggaaggctaagacaccaacacactgccaccagcctcctgccacctgaggggcctctgtggggccttcaaggaggttcagagaacactcgaggggagcacttagggaggaactggtaggttggggatgaaaagtgagcatgtcacagtgactggtgactgaatggggaggagagctggcaggggagagagggaaagtgggctcagggtgaccatgcttgggagggcacccgcacatggccctattcctgtcaatgggtggcaaggaggctgggaggcagaggacctaggactctagaaagacaaagagaagaaggacagagatggaatggagtcttagagaactggtgctaagcctggggacagtcctgaaaggggcacagtgtagagagagataatttgaaagacagagagagatgggaaagacaggtccctcttagatggagagatggtgctgagtcagacacttccagacagacagagagacagcaatgggatttgcagtcatggacatgattgatgtgagaaaaactgctacaaacattaggacagaggggccagaaagagacaccaggggataaaggatttgcagaccatcttctatacagagagatgaagataaggcagacagagaaagtgggcaggaaagacagtcctcagagagatgggtgtgggaagacaggccaatggcatgtgcctacctgaagtgggagaggtggatgcgacactcatcccgggaggcgtgggcccccggccgccccaggggcctccataccttggcatccagcagggtagtgttgctgctgtaggtgcgagcatggctgggctgctcggcacagtgtttgaacgtgagagtgcaaggcttcaggaaggaggccccatgggggccacatgccaccacagggcttaccagcccctgggcttgggacagcgatggggcgtccgacaggtcccacaccaggatcaaagacacccgctcctggcggcccacagccacagcacctggcagggagagggagagctgagatgggcctggtaggcaggcacacccctgcccctgaaagaggccaggccagagagaaaggaggtggggcaggagcccaggagagacccccagcagggcacacagggaagtggtatgaacaagagtaagacgactgtggagctgacttgtagtgtaaccctaagcaagacacttccctttccacccaggctgctgctagcccatagtgtgccttgtgtgaatttgcaaatggtgctcttccctccctttactagagaattgtcacagcatactgattcattagaacaaggcactttacttccacctgccaggaagttgtcccaaaagatatgtaatatgtccatccctgaagtcaataaagctatactcaaaatataaacaattatcagaagtaaaaggtgtctatgaacattgctccctcagatgtggtgacctaatgtacagtctgaccaactgtatgcggagatgagagccaggagctgttacctggtgggatgagcaaggagatgcctgtatcctggagcatcaggcaaccgccgcggtgatccacctctcgagccgaaaacaccaacagtttgtgcatcaactggcggaccatggtctggccttgagtgggtgtgtgtagctcctggtagaaggcaaccatctctggcagtgtggctggcaggtgctgccttgagacctcattttctagttggggggtaggctgggacactggttcctcttgaccattcagtgtccagcaggcccccagcagccttctagggcagtgccatcgaaggcattgggccagaaggaggacacttgccactgggacccccaccagcagtaggaactgggagggttggaatgaactctcctgggggcacattcgcctggttactcaatgccgctggctctccttcacccctgtgccagccaaagccaaaggcctggtggggaagaaggggtcagtgtcagggtaagcccttttaagttgtggaggtcaaggcttggcttacacatagctgcaagttgtcttcattccagcgcacactgcacactttagtcacaccaattcttttaacctgtctctcttactcgagaacctaccctggctccccgtgacctaatacatcaaggtaaactgttctgaagcagagtgagcttgggtttacagttagagaacatgagttcaaatgtcaccttggtcactgtggctgggtaaacttatcatattgatgtaaggcaggagagccccaaaattggggcttagtttgggagggtttgtggcttcacctaggcaagaattcaagggtgagccagtggtgtcagacagcaactttcactaaagtggcagagtatagcagcagcagaggtatgctccttacagagcagagctaaccctaggcagtgtgcccagggtagcagctctggggcatttctgccatcatatttatgtccacttttaattacatgcagtaaggggtgggttattcagaaatttctagaaaaaggagtggtagcttcgggtcactgccatggaaaggggcagtaacttccaggcatcgccatggcagtggtaaactgtcatggcactggtgggcatgtcttatggagaggtgcttttggtgccttttccctgtttcagccagttttctatctggcctggaatcaaatcccacctcctgcctcaatactgcttaatgtacctcagtttcctcatctgtccaaatatctaccttgatctacaagtgctgatacaaaaaaatctataagtggaaaaagcaagtcgcagagagataaaatattctgagctcattaatgtgaaaaacaaaactgcatataaatagatacatatttatgggtgcatatatggaaatgtaaaggtatagagaaaggtctggagcagtggtgtacaataaaaatgtaatgtgaactacacatgtaattttaaatttcctgatggccacattaaaaagaacaggagaaattaatacattttatttaacccaatatattcaaaatgttatttcaacaggtaatcgatataaaattatgagatatttttactttcttccttcatacccagtctttgaaatccatgtgtaatttatatgaacagaacagctcacttgggactggctgtatttcaagtgcccagtagccacgtgtactaatgaatccggtcttagactgtgcaggtctggaaggacacacccccaaactattcccatgagtcacaacaaattgagaaggtggaaggtgtgaataaaaactttgtatttttttaaatccttttctctgtactttgaatttttcacatcaagcatgtagtttgtattaactttgtaattcttttctgaagctattaaaagtggggaaaaagtgcctctttgtgtaatggtgaggatggcataaggtcatgtgaaaagtatttgtagatgagaaagcactgtccaaatgtatgtgtttctttatgcccctccttctgccagaaaggcctgaaggtagctcacagggataggcaacatacaacaagaacaacaaaagctaaaagtggaagcaaaaaaaaaaaaaaatgaagaagacaaaacacaaagatgcagccctacagtgaagctggaatgaggcagggcaaaagcatacactcacctcctgctcacctggctacccagccaggccacaggctgagacttcccagtagctcttcctgaggccctccagaacccacctccgcctcctcctacttcccctcttccagcccctacaatttccaacacgcctgccctgtagcctgcccaggctccccacacctgcttaattctagcctctggcttttgctcatgctgttttctgtttctccactcacttgctctccccacttgtttcctctccctacgtggatcctcccattcaatagtgcctcccgctggtgcaccggcctttgacagcctccagctcgcgaaatctctctccacagccatcccaccatactgagtcactcttgattatgtgctgtcatgtgtgattttcccactcaaatgaacattttctaagcaccggctgtgtatcggacactgtgggaagttcaatcctgccaaagatgacgtcttattccgctctcaaggagcttctgcaggaatggaattcattggcttggtagctgagttctgtgaggcacaacgtcctccttcagagccctgggaggcccctctggttgactcactagaggctgcactggaagagcttccagtatccagtcctccccacgcccttcacttgcactacccacctggaactgaggcttggcccaccttcttccttccaacctcaggacccatgaaaactgaagccccttcctagtgcctcttagaccagggcagaacctccactgtatcctcaggattgaagactggggcagtacctgtttctcccatgtcctcactgaaagtgtgaataagaagcgggggttggcattgttctctttgcctaaagagccaacccagcagacaatgcaccagcctttttcaaccaggcatcctggagggcacacaggtgaatcagtgaattggcagtgtcccaaagctgatgggaagggggttggagcagcaagctaccgttgatgtcccatcatttcttttggttctttcacattagtaataattataattccaactgtaataacaatagctaacattcgcagagctttactcaatgccactgtgttaaagcactctccatggcttgtctcatctcatcctcacagcagccttaggagcgaggtgttatttttatctccatttcacagataaggaatccgagctttctccccacagtgaagatggatagggaattactaaacaactgaagacaggcaggaaggaggagcaaagacgaacaaggacttccagagataccccctttctctctccaccccttcttttccccaagtatcttcctttccttctctagaagaaataaagttggaagagaaagaagcaaaaatgaagtaaagacaaatagaaggacctaaatttacatcctcagttatgtggtaatacccaccccactacaccacacccccacctaccaaggtaccagtggcaggggatggaattgctaaagggatgaaaggaggggccccagctcgcttacacagcagtaaccttcctggggccaccaaagaccagagtccagatccccagtgaggtgcacctcactgggtggtgcagtagagtcccctggctcaacctccgaccctggagaagttggcatgcaccactcccaaagccccactgggcctctcccagggtgactgctcttccaggctgccctggccctcactgcatcctccctctggctccagaatggggaaaggtccggagtcttgctgaatggcaactatagcactgcagccattcgagtgtgacttggggcatcccaaccccatgcctggactcctcattacccactcctccagtctgtcttgctccagaccccagatcaccctgggtagcgggtccccgaaacgagagtcctttagaatgctgccatcacctgtccctaggcagttgcatcctccagcacaaagatccaaactcctgctgcaaagttctgctcataccctttaagaaaactctcaacctttcctccacctcactggttctccctgtgcctccccaacacctgatagatgtccagttactgcagaacataacaagtactgggatggatggtccaaacccaagtcatgaatggcatttgttagtatagtagacatttccgcaggacacagaatcatcccagtggtcctcatacccattggccaagtcccattttcctcccctcctccagcagagggtccctacactccagcaggcaggctaagctggcctggctcctcccccgaagctccaggtaaccccatcacaatgcccatcccctctccagctgccccaagggggtgctcaacttaccgtctaggagctcttagaggctgctggctggtccagttccttctccgagaaacaagggtcagccagattcagtcggcaggccagcagacaagtggaggtgggcggggaatccaggcaggagtggcctggcatttcctggcagagccctgcctcccagctgtctaaagaggggtgagggagagtgtccctgtctattggcaaagtccagcccaggtaagggattagctgaggatcccagaagtcagtgaactttccagtctaggtctggaaggaaggagggaggcagggagacaacctgggtgtaggtgctgcaccttgaaacccctccttacagtgccctctgctggtgagtggctgtccccagccagaggctattattaaaatagcagataggaggaggagggaaccttcatctgagtttcttaaactataatgtgcacaacagtcacctgggagatcttgttaaaatgcaggctctgattctgtaggtctagtatggggcctgagattctgcagctcaaagaagctcccagctgatgccaatgcaaccggtccaaggagcttagagagcatctagttccacccgctccccacacagagaagacagtggagccactgagacggttaatgactcaccagttgctggtggacctgagatgtacccatatttttccttacacaaggtgctttctacttcccccacccaaagttggcagagacactgccggttgggagacaactgaactttggggccatttgccattctgagttcttaaaactctgcctaggagcggtggcaccacaagaatgaaaactccttgtggaacttttcccatgttttcggctgtctcctcagctcctggtacagcctgatagatagaaggtgttcaataaacatgtcttgaatgaatgagtgaagcagttgagagggaaaaggatgcattttggctccaactggccaacactgagcccaggtgagccacacgttgggtatgtaatattgggcaagctacttaactcctctgaacctcaattcccttgtctgtcaaatgcagttaagaatatctaccttgtgtgagataataattgtcattattgagctaataaatgtcaaatgcccaccacagaatgggtggtcaatagatggtaaccgttgtcaccagggtctggcctcctgcagttgaggaggcatggtgaacgcccccccaggcccctagttatcatctcccatagaaaataagtaacttcctctgcttttgtctcagttaataattctctagcctcttgtctctgactgcaatgccctcccctctgcttccttccctggtggaggtgagagggtggaataaacctcccaggggagcccagtaccccaaagtgcagagatggtagagagcgggcaacctgggaagcagacctcatgcctaaagacaagccaggaaggggtgctcagaactttgatagggaatgaaaggagtggggtaggggtgtttgtctttgttgaacaaagctctgtctgagtcacacaggaggctggactttgccaacagacagggacactctcccctacccctctttagggcggctgggaggcaggactttctgccaggaagcgccaggtcactcctccttgactccccacccacctccacttgtcagctgccttctcctctgagtcataaagtcctaggggtttgtgaaagatctgtcaagctagggttctaagccaggaaggtcatgccaaccaggaggctataaccaggggctgtgttcatggattatgaactcacttcccaagctagttcttgccactcttggggacaatcccaattataaggaggctctgaagaaatgtgaaggctcctaccactcactcccatggccacagagctggttcatgggatgcaaagaccacaggcatcaacagcattataactgggggctgagctgtcacaggagggccagtgtcaaaccctcaccacaagccctcaaacattccatcaaggggtagcctccagaggccaggcaccaaggagggtctggcagaccagaggggctcctcctgagaggaactctttggggccatgaaacagcaacttggacttcccagccagtgtcaccacccttctcatctgagaaaggcagatcagcagggagcaccactccaccctcctcccagccccaccctcctcccagccccaccctcctctgccttccacacatcatatgtcatcaggccccccgcctgggaggtgtgctgccagaggtaaggggagcacaggcctaggaaccaggaggcactgggagaggcaggtgtcaggagaaaagaggatgggggcagggaggggcagggagggggcctccaccactggacagaaatgtagaaaaacaggaaggcagaagatgagcaaacggacagtcaggagcacagaaagacaagtagaaatatgcacaggtgggcatgctgctcagctctgtcccagaacctccaggaccagtgtccctgacccttgacagaaaaggatggattagggccaggcacagtggctcatgcctgtaatcccagcactttgggaggccaaggcgggtggatcacctgaggtcaggagttcgagaccagcctgaccaacatggcaaaaccccatctctactaaaaatacaaaattagccgggcatggtggcgcacgcctgtaatcccagctactagggaggctgagacaggagaatcacttgaactagggaggcagaggttgcagtgagccgagattgcaccactgcactccagcctggacaacaagagtgaaactctgtatgaaaagaaaaaaaaaaaaaggatggattagatagtcagtccagaatactgaaaataatcagattgttttctctccttcaaatctggttaatcatggggggaggctgaaatatcatgaacaaatgagaagaatgatatttgtggggccttggtggggccttggctggaggagggtctgtacattgtcccacatgcaaatgacatgcaaagcaacatgccaccttggcagctttttaatcaaagaccaggcagttgtttccttgaaaagtcaggccacaagaaacctggatgcttgtgcttacatcctgacactctgggaatggaaagatggagcaggaagctcataccccatggctccaggggtagaagagagctaaaagttcagaaaaaggaatccacggtgtcaacaggccaagtttgaatttgggcaggagatcagcctgggtgggccccatgagtgtgccagtctgatatggtgagataagcctgggacagatgtgctgccgcattcgtgactagaaaagagtccccaggaatttctggctcctgccttcagattgtgaactttccaggttggtagatcagcttaggtagaacagttctcggtgagggccagctacatacctggctaagcgctgcccactgcagaaaagctcatcacccgggacctgatctccaggactcagaagcacttggaggaaggcctattcacttagaagcagttaccagtgctgggcagtgtcctccaagtgccagaggagtgctgtggagaaaagaagtccatggaagccaggagatgggcaaggtgtggcctggggttggagagagctcagaggtacaggactggagctgggccagggagagaggaaggacctccgtgagtagaccttctctgaggggctcaggccaggaaatgagtcaggttaggaggcagagacagacgaggagccgcaggggaaggctcatcactagcatgttctctgcctccccagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtggggtgagtacttgtttctcacacatggccctggtacccaatggggtgggaacaagtcctctatatctgaattactcccatatattggcctccaaaggtaggcgctttgtcttgcctctcaccaccatagtgggtcctccagaaagtaagaaaccctctatgcctgcctggggttccagttagcccttcttccaccctctctaagtctccccagcccctcctccacctcaccatgcccagctcctcccaccaactccctccctggcccttacatgatgcctaaacccatctgcccccatttcagcccacaagggtatccaagagtccttatgccagagagcctcctccatttgccacggaacctcctcccactgaatgtttttgccaccatgtctccacagctatgcctcctacctggtgtggaaggacctgggagggggcttggggtggcccctggccctgcctcttggcctctatgctgttcagctcaccatcagctggactgtcctggttctctttttcacagtccacaaccctggtctggtaaggcacacagtgctcagtagcagaagtaatgtgggagagggtgaaaccacctggctccagaagcacataattcagcagagcaattgagtgcaggcaggtaatgggtgggcagacttctctgcactcccatggtgtgcacagagccccagggactgagctcgttgctgggctgggtactgcagaaaggtggaggtgctggttctcgggcagccagctgacccccggcctctatgcccaggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagtaactctgaaggtatgatgtgaagtgtgtatttgaatgcataatatgatgactagggcggcagagtgggatagaagcttctggacctctgtgtgagtgtgtgcgcgtgaatgaatgtgtgaaggcccatgggggaggggtgggcacaccagctcgcctccattcacatgcctccccacctggcataaagatttagcactcagatgtttaattacctgaaaaacaaaaggctttttaaaagtgacaaaaaagccaaaacagaaaaatacaccttaaaaaagggtactagggggccaggagtggtggctcacacctgtaatcccagcactttgggaggccaaggcgggtggatcatgaggtcaggagttcgagaccagcctggccaacatggtgaaaccctgcctccaaaaatacaaacattagctgggtgcagtggtgagtacctgtagtcctagctactcaggaagctgaggcaggagaatcacttgaacccggggaagaggaggttgcagtgagccgagatcatgccactgcactccagcctgggtgacagagtgagactccatctcaaaaaaaaagggggggatactaattatacatgttaaggttatatagtatatattatacattaatttatatatcagatttatgatgcaatatctagttataacatatactatggttgtatgatatatatgttatacatctctgataaataagattatagaccttcttttttgctttcatacattcctatgctttccttattttacatcaattaattactattagaataaggcaaagaagattgaaaaaaagagattaagcctcagggtgctgacaggtgaatccataggagcttcttgttcagccttctatcttgcttctctttttctaaaccttcttagtggctttttaatttttgactcctcccttctctgattttcttctgtccttgtttcaaagccctgatggtggcaaggagtgaccgcccttgagtaagcctcctcaaatctttaacaaggtcagctggaaggcccagacaccttgcagtagggggtctccacctgctgcatgatggggatcaccagaattgtttaaaaatcctcatcagcctctccaggaaggaggcctgggcatcaacatttttaaaacttcccaagacctcctcaggtgcagccaaggctgtaccacagctgtttggagctatttaaaaaaatgcatgttcctcagaccgcactcaggacccataaatgagaacgttgcgggtgggctcttggcatcttcagatttaaaacctcctgagcacttctgtcagctgctagctagtttgagtgctttgggcacagatcgtttatcagggcccgtttagccttgacactctgaggttttgtgagctgagttttagagctgaaacaaactgtatgctctcaggtgagaagccagtaaggcagcataatttgagaagaggagtggctctttccagagctcacccaagagagggagtctgcagcctcccctcctccaccaagggcatgctcagcccagtgggtcaggtcacaggcaccccaggaggacacacacagtgtcccacccacctttgtatctccagccccaggacagggcagagcacagagtaggtgcttgtacgtttttatttgttgattaattgaacgaataaatgaacacattgttgtactttaaaaacaaatgctgaccagcacctgccgccacccctacccccacccctactctggaacaactgaaaaaagaagggaaaggctttaatcattttggaaactcctggttctaatgtgcagccaaactgagatgtgctgctgcagggtattgcttcttactgcttctcaaagtgtgccccagagacctcctgagacacttgttgggactccagacccatgaaatcaggtcatcttggggagtgagagcaatagggtatggtgatttgcagttctggccatggagtcagaccaacctggggttggatattgactctgttatctattaactggtaacctggtgcaacttctagctataaatactgatggacagaggataggctcggaacccaaaatacatgggttcttacccagctctaccaccattgtgtgatcttggcaagtgggcaccccagacattatcttccattatcattattatcatctcataataatatatgcattgtaatatttgctaccaattttattcattaccagctaattctagaagttaggtggaacctccaagaagatgtatgatgcctagggtattactttgacctccccaaggcaagctggagccactaacccatgcctctagcttaggacttagccctagaagaaagcttaatttgggcagtgtcccaagccctgggctagcacgaccgcctgatacagcatgagccaagctaaagagatttttggccatgtgcagaaactcagcatgaaagggcagaatcccaactccaaactcttatcctctaactccaaagttgtccttaaaatcctcctctgccccagctccttggttcctgggtgaagggagcccctaatcccacagtctccaacctccctggggctcttatctttccccttaccccacttcccagttcagagcccagcctagtggacacctgcctttgcccctcctctcttgttacttaagagctgtgcctaaatagacttggagctgcctcttctctttgcaagtgtatcccaagcttccaccattcaaattatgtgcacatttttgttctgaggcagtatttttccatttgcctctgatttggttgagtcggagacagacaagatcataaggctctgcagatctcccgtccagcggctagagaggcactaggtaaaacagcagacccaggaggtggcatatctcattctattgtatcctagttcatcctttcctcttctaaaccttcactcttcctcactttgccaatttctgcagaatggaaacatagagaggctaggtgagatggcagagtggtaggtgtatgtctagtggtcaaagattggtcagctgggctaggaacagggcagagtgtaggatgtatttattctgcacatctctggcccctcctacctacaggcaggtagagctgctgcgcaggagatgcctagaggcccctgaatgttgtcagtcctgggccagggctccaaagtctcttttcttttgtgaatggccactatctgctctgtcgcttggggctcccctgtaccccaagcccagtttcagagtcttcccagaggtcccctttcttgtagttccagaaaacaagcacacaatccttttgttttaaggattttactgctgattctcattagcagcttacaaggtactcagtccaaagcccaactttgctgagaactccctcagatctcgaccttcctcttgtatcctcaagtagagcccaaaaaaacatttacttgcctcccagactccttctccccccacccccaaatgttgaggacactccatacatttaggctcttcttctggtatggaagccaggggaagccatccctggtcacaccagggccttgatcatgttcatcagggcctcatttgtccctttcccaggtcgcccagcccacacagagattatccgctaagacaagtaccagaaaaatccccctagcgtccacttgcacctactctaacacatttctcattttaagggctgaaattcccctctcaagttgattgtagtttgtcacctcttcccagtaggttctttggccttgcaaacaccccttcaaagaggaatactattagtcaccttaatgtacatgatccttatcagatcactttctttaaagactgaaagtgccagccacgggagctgggcagtgccaggagtagccactggaatggaaaccatggtgaccaggactaaagtcaccattttacccagggtggtgtgtcccacatggcaaagcaagcattgtgtcctgtacagaagactgtaaactctgtcctgccctgtgattctggtgccttctccaatcccagcctcagactctgggagacccttggccccctcccctcttcattggccaaggctgctcaaagccctggacacctcacgtttatatcaacagagcagttgctagaggaagcagcctcccgccctccagaggggtgtctggtgcccgagccctgttgtttgtgtaccttgtctcagtagtgaccagaggggcaggcaggcctgggctgtgtctctggggcaacgtactgttggggtcccagctgtccctgcacataaagcaccgactccatcaatgcacccctgaggtatcctctttcagggagtgagaatttaaaccttcctctggtgaggcttctattttccaccagccctgctcctggcctctctgctcccttcccaatgagggcagctccacatccagccaagatccaaggaacaaccatgcctgaccctgtcctctccttctcagccacctcctagaatctctgaatgttttctgaaatgaccgtgggaaacaggacagggagaggcatgctgcagcgtatcccaggcctaacccagctcctttcagccactgccatcccaacagaagggggcaagggcctgcagagacaggctgggaggattccaattttggtttccatccccagatactagctgtctggtgtctctttacctgtacccccaaaacacagatacacacacacacacacccctcatgtaccaattactccctagagtctgtttttcctgcaagaactccttctcagcttcttcaactcccactggtctctgtccttcccttctcccagagctgggcctcatgggtgctggcagcagttgagactgaatggtgaaggaggtaaaacatgactctggaagcacatggctctgccctctctagctgcatcaccttgggcaagtcacttaacctctctggtctcaatttcctcaccagaaaaattaggataataatagtacctaccccaaacatccttgtgaggaataaatgagttaacctacataatattttagagtaatgtcaggccagcagcaaggactgtgttaatgtcagctctccttgttactaaattccagggaatatgacacagtaggagaagcatggaacttgggagctgacagatatgggttcaaatcccagcaccccactgactccacatgtgaccttgaatgaaataccttactgcccagtatcctcctgtgcaggagggggactactgatagaaccttacccaatagggttaacactgggtgtggggtgtgccagccctgaagagtatagaggcagctgtagggagaggagtcaagctcctggaatctgatcccccagattagttgctgcactctggggtgagcagagtaaactggtctgacttggaaagaagagccagagaccagccaggaattcaggcccccaggaggtgccataaatagctagagcagatcagagggcctccagggatggcaggctgggagacggggaaggctcaaaggagcagtgaaaaaggaagctgtcagtcatcagtctgggggcagacccaggaccctctcccaaaggtcgaagggaaaactgtctataagtaagacagaagaaaggggtcaactcttaaggaccagcctgagaccacctgggcaccattcactctgagctgttgggagaggcaggaaattctcgacacgccattcacctgtggtcttcacaagcccactcggcgccctattttctgccctttgaccatttggaaatagaaatcaatagcacagcctgtgtcacagatgggaaaacggaggctcagagatgtcaagtgatttgtccaagatcacacagtgaatcgggctaagatggggatatgaacgtagaatattttttgcctcctaatccagggttatacatgacagccaaaatagaaggccctgtcctcagggaggaagtctttcttgcaggggaacagtgaactgaaaggatccatcctccttgctttcctccccaagacattttactcttcctccgttgatccaagcatatcaccctagctgggcctgggaagtgtgagagggatgcacatttataatgcttcagagatgtttcatcaaaggtagctgtgcgcagccctgggaataggctaaacttgaacttgggctctgaagacctgaactcaaagcccgtgtgatcttatacaaatcacttcacctttctcagccacaagtccctaacttgcaaaatgaggcccataattcacacccatgtgagactggtgtaaggactaaatgagataatgcatgcttgaatgcttgattaatgccccaaatatgataaaagctgggatcccctggtgagccagcaccttatttatctctgtactcttggtatttaccaccgcacctggaacataggaacctctgataaatgttgactgaacaagaaaatgaagtaaactctttacatttaaacgtggtatgtttgtgtgataacaacattctttgcagtttatcagctgccactgtctttttattgtggacacaggcactattatctctactcagtgctttattccccccgaaaaatgtttgaaaaaataagatccagataaaaatgctttcagtggctgggcgcggtggctcatgccacccagcattttgggaggccaaggcaggcggatcacgaggtcaggagatggagaccatcctggccacatggtgaaaccctgtctctactaaaattacaaaaattagctgggcctggtggcacatgccagtagtcccagctactttggaggctgaggcaggagaatcggttgaactcgggaggcggaggttgcagtgagccaagatcgtgccactgcactccagtctggtgacagagtgagactccatctcaaaaaataaataataataatccttttagtagtaaatccaaaaggtaggggaccatataatttattgtccacagcgggacacctttgggagtaaaggggtgctattagtaattatgtctggacaacaggaagaaaccatgactggcaaaccaaaatgctgggcatcacactaacagagcactctgctgctcagactctctggaggagtgagccctaaatcttccaaaccatcttgactcctcttctttagtcagaccctccaaagggtgccctaccctctcatccccaccagccaaacccatttggagctgttttcagatccgttccccagtgttcttaggttcctcattttcaacctacaagtgaccctgaccccttccttctgcttccctgagaatggcctagagtgtttgcactgctccaaacacgaagacttttgcctctgctaagtacccatcatgagagctgcaaaaatcatctagccatcctctgctgctgttccggctcagggtcttttctatgggcccccatcatctctctctggcctcagtaggcttctcactggtcccctgcctctgctcttcccaagtgctcagaccacctgtctcacctgttcagagacaatggcttcccacctcagtctgagaaaaagcaaggtacttatgacagcccataaggccccagtcccttttacccttgttatctctctggcttaatctcttagaactcttcagtcacccagatgtatgtcctcgctagttcctcaaacaccccaggaatgctcccttctcagagcctttgctcacgttgttcccttccttggaacgctttcctcttagacaaccaaatgattagttcccttgccttcttcacgtcttcttcaattgtctccttttcaaagtccttcaccctggccatcctataagtacgtaaccccacctcttagcacttcctgtttccatttcctgtcttttctccttggcacttgtcatcacaaaatagaccatgtattttacttaccttatttgttgttcagttcctcaagctccacaaatcatcacagcagggattttcatttgctttgttcttttgccatattcccagtacctgaaacagcacctggcatagagtagatactcaataaatatttgttaagaagaataaaagactgactgtgagggcacatagcatggaggttgaatatttggcctgaagtacaaaagcctgcattttaatcccggctctgcacacttctgtgactcagtttacctgtaacttgggataatacacatcgcctcccatggctgtggcaagcatgcatctgatttcatttaaacccctaaacccactgcctggcctgtttcaaaatctctgagctaagtaaatggcagctattgttactcagggaggctcctgatcgatttgacttacattatggctttgtaacaggcaaatcagcacccaccgcttttgagtcataactcacacacttactccccaaattgtcagttttgatcccacctctgccaggacccctcctttcctgaacccacgttcccccaaagcaaatggcctgggtctttttgcagtcagcccctttcaacacacatctcctcctgtttaaatctcagaaggccaccctcctaaatctcaggatgcctgccctggggccccttccacactctcccccagtggagctagggaatttgggtgggaaacaaaggggagaacataaggtgagctgagagggagagggagaagagagcaggccaagccatacccacctgccaggttcctgtctttgcctactgataaataggggatactaatggccagattttccattcccccaccccagcacccgctgtcactcaattaaaaaaagatagagggagagagcctgggggaggggcaggaggccttggctataaagcctgtggctaagtggggaaagcacgaagcctggcctgctgggtccttttcccgtcatccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacagggtaagcctcagatgtgggtcagggttctgctccctagaagagtgcagccttgggttaggctgtggaaattcaggatggttatattaggcgtcagggacagctacaaccctgcagcagtgagagtgcaccagtgggcccggcaggggtggtaggggacccagcagcaaattctcttggcttctcagggtgacaccttgggctctctaatcagggagaggtaggaggagctccttggaggcaaaagcccagagaataaaaccacccttcaggcctcctggtattgggatggccacctgcctctctgggtagaagcttagtcccagggagtttggcgaggacagaggatgagactggcacatctatatgtggctccgttcaaagcaacccttcccctcaacttctctgttcctgagtgggtctctccgctagccataggcctctagccctttctttagagcttcttcctggagtagatgctcccaagacaggaaagatagatccatcctttcccaagactcagaagcagcttttttcttattaaatcttttgagtctcctcaggggctgtcccacagagaaacagagaaattacatgcagataacgcagcccaggagcttatggacacaggagctgttccaacatgctcaggcattgcctggaggaactgggacccaaagaaaagggtctacagactgcaaggagggggctgtgtgcagggtacctctgtcttatccagattatgccatctccaggaataaaactaagtagtcttcttcctcttccctttctattcctgtagtggaagacccttctaaatcctgagcaaagaataaaaagagaatctatgaggccatatttcctccttgaaccaaacgttcccttcatggggtctccaggaatgaccacaggcagagtgggtgcgagactaagagaagtttcaggaagaaaggaggcatgatgctttcaagggggaaaggaagccctgagtggcaatttggacttgatatttcaagcttgacaagtgattttccagtcagccacagttttagcacttataacatgaagatctatagtagtaaggtcccttccagctcagatgttttctgattttcaagagaacctaagggaaaatgcatcctatttcctgaggcaagagtagcccctgaatttccatttgcccatgcccacccaactaatctcaccctcatcctaggattaagggagcagctgggcacagattaatatagacacagggaaagcctaaggcagcctggccaggagagtcctcaattccagtggctttcttatggaaggagagcctttttctaacacctaagcatgctggtatacgctatccttagtcatacacacacgcgtgtgcacactacactcttgtgtggctttccaacacagagggagggtaggtcaagaacagaattagactatgtttgttcagctgaacatgctttgggggtcccagagcaatggatcctgaagggttaagtccactgatataacttacatttgtccagggctttataatcacaacatagtttcatgaacatgagaccattcaacactcagcacaaaggtaggagagggagatatattattgccactttacagagggggaaactgagactcagagagattgaatggtatgtccaaaaccacagaactggtaggtggcacatcttcttactcccagcaaagtatcctttctactggtttcttattcattctggatcccaggtttcccagagctccacgttatctctatctgggaggtagtgaggacccaaggctcagaaaaaggggcacagaaggggcaacgttctgagcattctgtgaacagttcaggtgggagcagagcgctgagtgtttcctggccacaagtaacagctgtagagagctgtctcctgggcccctctgggtaaacagatggcttaaaatagcccagaggtgcagctgggtctgtgcagggagagggtgagggaatagctttcctctccttccctcttgagatgcattccccccaggactccctcctggagtcaagggggtcagcaaagcagcttttctagcctggtctcctatagggaagatctttagtgctccttatatttgggccaaaaactagcagaagagcaggtagcttttccggaaacagtccgacatgaggagggtagctggtaggaaggagagatgcccagctcatagcgattctggttgaatagggcattcaggatagaaagcggaactgagcacattaacaaaataacatggtagaatgttctggaaaagggcctaagcctgccgtagcgtgctgaagccagttcctgttggttcacaagtctcttccctactctgcatccagtgatatcacctcgggagcttgaaatctctgtaatgggagtacttaccttatggaaatcagcaaactttagaaattggggattcttccttctatcagagagatgagtgttacacttatcagcacaccattgaaaaccagaaacctctgaaagtgagaggaagagcagtgggaaagggatcaggtttggtaatgcttaagacggagctctgaaggatacaatttgaggcctggagaaggcatcatatgtatcatacatcaatttcctttttcttttttggagatggggtcttgcttcttgctctgttgcccaggatggagtgcagtggtgcaatcacagctcactgtcgtcgcaacctcccgggctcaggtgatcttcctgcctcagcctcccaagtagctaagactacaggtgcatgccaccacgcccagctaatctttgtatttttatagagatgggttctgactgtgttgcccaggctgctctcaaactcctggcttcaagcaatcctcatgcctcagcctcccaaagtgctgggactattggcgtgggccactgtgcccagactagctttgagtgtctactgttgtccaaaaccttagaagttagattactcactctttcaggtgaggaaactaagcctcagagggattaagtcatatggccaaagcttgttgatggagtaggatgtgaaccccaggactgtctgactccaaatcatcacactgcatccaaaaaaccagagaggattctttttatatttactgaataagagtttttcatttactgcctgtttcccctgttagtatttaacctctatgaggacagcactttgtctttttcactgctttatctttagcacctagctcctgataggtactcaatacgtatttgttgaataaatgaatgacctaatgaataagaaccttttgggtggttcttaggctctctgtcagacaagacagggaatgaactgggggagggtttcttgaggacagcagctcagggtgtatgacgatccagcaacactagatttaggtaagaattcccctggctcatgcctgcttctggacacagcacgttttagtagagctctggggcacgagagctggttgtctccccagctttccaacccagtgagaagtgactgtggctctgcctggcagcacccttgatgtgagcttggctttgtctctagttatgttgtatatgtttttacagaaagcagaacctcctatcccagggattattatggaacaaagataaatggcacacagagtgattcttcttctaaccacttctttagctaccagtagtttactctagccatgtaaggaacacagagaggcagtgtccagaggagaagggtgagataaggagtgaggggacttcgacaccagttaacaccagccacagccctttaccctcaccctggcctctggagcacgctgggtggtgtgtcaccaagaagagaaggcagcgcactgactctggccaacctgccttccacagagggttgggggcaggtcaaagctcaggtgtgaagaccatgcctaccagggaaaacaggcaagttcagggtttcccttgggcaaaatcccatccagtcccacagtctggagttcccttctcagctctagggagtcaggctgctagaaccctctgctcctgctcttactactctttctgattatgcccactccttggtatccgctttgaaaagtggtctgagaaagcagaaggccaatgaaaccagcaatcctccctctttcacgccagtcaccaacaggtctagtgagggaaagctgaaacaagtcaacacataattacctatgagtagatttttccactcatggattattctggagcaaatgtttaatctcagtccagcttcaactgccctctgggttgcttcctttcacagtatagatttacgcttagaaaattcaaacgttttgaatgtgaacctgagaaaaatgtattacatttactcacatcccttctccctccatcaagcagattatcttcccaattttttttctagatatttggactctctgtttcctcccaagtgaactgaaatgtccagtagcctgggtctaagcagatgaagtgtgactggtcttgtttggagaaagtatgaggaaatggtgcttaacaaggtgctatcagaggctggggagagggaatagaaatcaggctgtaggtttctacgcatgaggaagtgactggatcagggaaagaaatctactaccagcatctctctcctgaccaccacccaccaccaccaccccaccccacacacacacacacacacacacacacacacacacacgtttctacgcatgaggaagtgactggatcagggaaagaaatctactaccagcatctctctactgaccaccacccaccaccaccaccccaccacacacccacacacacacacacacacacaggtttctacgcatgaggaagtgactggatcagggaaagaaatctactaccagcatctctctactgaccaccacccaccaacaccaccccaccacacacacacacacacacacacacactcacacacacacacacccccacccctttaccagtaaaatattttctgggttaaatgtaaagggctatagttaaatatgatacttaggcctatcatgctacttaaaaaaaactgctggtgatgatttaacaagttaggtgtcattatttccttccttccactagtgggcataatagtgttaatttattctgtgagtctacaaaattgcccaagatggccatgttgtctagttccctggagaaattccagacttctactacctctgttctcctggtttccccccaggacgtagctatttcggtctgtgagaggcctaaagaatctcatctgacctttttgctccttctagaagaccaagaaacccattcagaaatcaagcaagtttagtctctgagcaagcccaagggaacgactaggaaccaaaccttccctgcctttcctttgctccttgaaagcacttcttttcctgaggcatctagtccagaaggccctgctgagggacagagtagattctagggctgctggccagaggggttggaaacccgtatttatagagagatgacctttcttcctctcccttgggtttcaggtttctttgggtcttctcctcttgcctagggaagaggaggaggggaaaatgtcagagcttaagaagggcagaaagaaacagtcacctcacaaccatcaaagccaatttgcaattgcatgctgggccaaattcacactggcctaaattcatactttcagctgagctatagggagctccagaaggaaaagagggaccacacagcagctactgtttaagcttccaagctatttgagtagccatgaatacttgccagggttccacctgataatccatcatataggtggccctggattagacttggggagtggggcaaaaggtcttgaagagcaagtttgggcaggaacggtaagctctgagcttctcaaaagcaaaaagccactccaggaagtgaagggaccatttggcaactggtaaagttgaggagtggtctggtggggtgagtacctttggggagcactcactataagtgaacgcctgacagggattgagaagaggagcagggaaacatcaggcgatccattctcctaaaatgttaagtaaacaataaacacctccaactagggacacaggggcttagagagctaagtatagtacctgatggaatcctggggctgggtcctcaaacacatccatctccacagtggaaaatgaacctgacagcacgggacatggaaacttgggtggatacattttggtgatgggtgggggtgagggaatcctgcagggaaataagtcaagtttactcatatctttggcatctgctgctcatccctaggcagccaaggccctgggataccagggattcccctgcagcccagggagtctgttgacttctttggggaaagagaagaggtggagacaggcaatagtagaattaatggtgccataggtatctcttggggcaggcagagagattacatttttaaaaaggaaaacattgaatctttctagctggtactcatctcctcctctcttgacatttttcatctctcctattaaaaattcattttctttggacttcaaacttgaacaaatcttgcctattttagaaaaacacacacatacacataaaagtaaaaacaatcttcaactctgatgtcttctctggcccttctcttttttcttctccttgttattaccaaaattttcaaaattcctggacttttcctgctgttttcatttcctaaccatccatctcctcctcaaaggcacccacacaattcatcaccaagtttagtgtcctaagatacctactggacttgttcaatttgaggcttttcctcagcttcacactatctgcctattgccaagactgtaatcttgcatggacatcatttttattgttttccttctcaagaacctgtaacaattctctactgcctcccgaatcaaggccaaactttcgagaaccttcataatacttcctttactgtacctatccaattttagcagtcttataatgttctcagctgttttatttacatcttctctgtccagctgcaatctagctgctaaattataagcatctggagggcagagaccaagtcctttaagatttggaggtgactcaatactaaatacaggcttaactatcccaagatacccttgagtagtctgtcctcacagataaaaattcttggacacttagcatgtgacaatccctttacctgaaagtaaacagacttgagaagtagtcacttgagaaggagagcatgttattgcaagttttaggccatttcatgccaagatgcaatttacatgagttacaaggaagagaaaaaagcataaaatgctctgcaaaatctttgttttgctctgtcatgagaaattttatatgcttgctacttacctggccacttattggaatcatccagagagctttttaaaaatactgatgcttggaccacctctccacatgttctgatttaattggtttggcatgaggcccaggcactgacattctcagtcttctaggtgattctaaggtataggcaggttaaagattcagtgatttagaaatgtaggggtatgttgtgctggaagagtgatggtggagacaatgtcctagtagggtgaccaaaatgcacacctcagtccaaattctcctctccttcagataaacccttctggattttttaatgcttttttttttttttttttttttgtcactgatgttaccacagacaagacctatttatagtaagagtgaatgcatttctgaagtactgacctggaagagctacctactctaggctggttctagaaacaagaacttatcattctttcctgtccttttgtctccttgacctacagagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtgagttttcctggtgccatggcaccaacactttattatgttaactccagtagaaggtgtgaggtcaggtagaatctgtgatatgtctgattttcctttggaagggtttcatttctctgcttttgactggttgcaaaaatagtttagaacatgtctctttcctctgaatccctctctaaacttttccctcccacacttttgtatcaaagtaactttcccctaacttagaatactcaaggttgacaggaatcctaaaactttcatgaggcaagatgacgttctttggtaagatttagatggtgcaagcacctgctactgaaccacagcagagaagatactgaaatcctctgagtatgcccctgtgtacatgtcagggattactaattccagacatcttctagatgcctcactcccatatccactggcaatcttaccattccatttttctctaatgaatgttttttagtccttcagggacaattttttcacttatggtaattttgaaattccccaaatggactggtatttaacttgttttaagccagacctgctttcatgttttcaaacaaatggctacactttgaaggagaccaacaattgctgtgtgaaaatacaatacgggaacattttccttatgttgagaagacctcagtagaattcatggaggatgtcgaatgcaggaatggggataatatagcaacaagctagtccatgcaggaacatttaaagagttaaaaagacatttgtaaagtaggcagcagctcagaagtaacctcttacagatatcaagaggtgataggagaaagattagctatttaagcaaataattaggacacaattaaggccaatttggcctcttgctgagggtaaattaaactctaacagaaacaggctaattaccctcaggaaagagggctaaaggatcctttactatcttttttacatttagtctgattgagtttgcgcctacagaaatgctatgacgaagccccctttgcaaggccccagttactgatcaaaatcttccagtaatagaggaggggtactcacgacactcttacccaactttaatcctgcaacaactcacatattactaaaacatgaaaacaacaagcttccatgaagataatttacttttggtctctctcactcctaacacccttaagagaagatgtcgcttcatagacacgtttaggaaatatcaatgttccagagcttgatgttggcaggtgttttctattagacatgcacatgggcacctgatcattctcaagctgagcatttgccaacccatgaagatacaactttcagccatttcttttaaaaagcaggacccagtcactgaagtcagtgagcctatgatagggtatactgtgtggtactctgctcacataaaataagacactttatagtggtgaacagtagtcaaaacagatttctgagggtgccctctgagaatataaaatttaacttttagaattccttgaagattttgttagtgtatgtactatcactgtaattataaacccaacatagattctacagactaaccggcagcttaaaatttaaccccagtatattttcctttcagacatctttcagagtcaagggcccaggtgcctaactagcaagtccttagagcttttttttttttttttttttttcagtgatttcaaatataactgtattatctggacccattaacatgcttccctgtcttctatttgaattgctcatgtttgtgaagggaaaggttaagatatatcaagttaaaaaaaaaaaaactggcatgagataagagtgtaatctaaaagcccaaaagaacaaccctgcttaattaaaataatcttgagaaatgagcatttgttaaataaagtgtcttattttacatacttatttcatctttcttttttttttttttaatgacaaaatagtatttaatcctatatttagtcaaaagaccagagttaaaccagatctcttctggggctttttctgtgtaaaccacatcaaaacatgaacgaaagactggcttctggtttagtcaatcctggtaaatttacccaatcctgcaaaggaaactatggaggagaaatccagggacttgttgggaagggcacacagaaaccttagttcaaaaagaaactagtcattgttcggggccagcagagctctcagtaacacattttctttgtttgttttaccaaggtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttttcccgtggccagatttttaagaaacttgaacatctggaagttgccacagacaagcgagctagtccagacacagggacactccaggctatgaaccaagccatggttaaaccaagacttgcctagacaatgcagaataactctcccatacagacttcttacgacaatcaagtgagggcctttcccttctctgaaggcaagtaatagggcagaaggtggaacaaaaagcatgagaaatctaaggtagccacatcccaaatgccagttaataagcaactagcttctttattagagaggagcgggtgaaaagtagtagtttaatgttcagatatacaatcatttaaaagtattcaatacatggtgtttgatggtaatggcaggatgatgtcaagtctctctttttttttttttaaaggtttgtttgagtcctatgtggaagcaaaaattcacaggtgaatttccgggtgtttgccaaactctaactaggtttccaggaataatgtgttcactctgattaccagggcatgcctcctttcctcaggcttcaagtgtgataagtcgtcggaatttgacccaagactactatcggcaaatgacaaagtgctttatcacattcctgctaagtcccagaattccacttacagccaatcctgaatgagactaggttttgtctaaagaatcaaggctcaaacgccaagaaaaaaataataataataaccataatctctttaaaagtaaaggaagcctagaaaatccatgttttgacttgtgttaaggtttacagatggtactcaatttacaatggtttgtcttgcaatttttggactttacaacggtgcaaaagccatacacattcagtacacccttcaactgaactcaacttaagatggggttacccagacatagacctaagttgaggagcatctgtaattgcagagttaagcaaaatattttaagtttctttaagtttcttatcccccactctcactttcaattttgtgtatttagataatctctccttcctttttcccttcaactttatgtggacaaaagcaatgcttcaagaaaagcctcaatctaaaagtttgataatgaacttgaccctccactgcccctaccccaacaacatgaagaacttgtctgttccacctagaaatacaaaagtgaaatacttttttgaaactgttgcctcttatcaggctgatatgtgataagaacacagtctaaagtacaaagattatatttaaccagtactttcctggtgttttaaccagccccttctaaaatacagttgttcttttatacttgggaaagcagcaagtcctgtgacagacccaaagtcactctagggagaaaatcaatagcaagtctggctgttttaactctcaacaccactgtaagggaaaacaagaaaatgtctagtttcccgaatagctctgatactgaaccattggctaaatccatgaactttattttcctaccatgaccacaatagacgactggtctttgcagcttcggaagaaaagaggactaatatttagaccccagctggctgcacatccaaatcttctatggaggttaaaaacacaaaagtggccatcccactccaccaccaaatttttttttttaattgagatagggtcttgctctgttgcccacactggagtgcagtggcacaatcacagctcaatgcaacttcaacctcccaggctcaagccatcctcccgcctcaacctctagagtagctggaactacaggcctgcaccaccaggcccagctaatttttaatttcttttttttttgtagagacagggtctcgctatgttaaccaggtttgtctcaaactcctgggctcaagtcatcctccagtctcagcctctcaaagtgctgagatgacaggtatgagaattttttgagaggaagtggcctttatttttttaaagaagactcataaggatttttgacaatcactgatttattgggtcactagtctgtgctaagtactctgccaggcatttaacatacattatttcacttgttttcatgattaaattcaggcaggttcaatcacagaaaccatgcagtggacaaaagagagaaaaagttcaccatgaggagattctaaaaacctgccttttgacttgtctatttttatctcttatttctcactttgcttctcctcccgcttggaccctttgtctgactgtttgaaattaagttgcaggtgaaccctccattacccatgtccagaacaaatagacataagcacagaacctcactaactccccaaatttttatttttccatttttatcaccacaaatttcttggtaacaatgtagaatttaattttgtaattaaaacaaaaactctcccctaggaggaatctgatgacataaggataacaccaagttatgtgcacaaacgacaaaaaatgccaaactaactggaatgatcatccttcctgaaatttctcttaaaaagcagagaagtagaaccaatgctgccacctagtggccagccaaacaaatcaggtagcatactggagaaaaaggtcatagtcccgacaatctggtttccctgcctattatcaagccacctaactccttacttttccacaaaaaaacacaaccacatatcttaagcaagccctcctccacagtcataatccaaatacttgaatacagcaaccaaagtctgtcttgttaaacacactacttctcatgaaactttcctctgcctattttaaggtaggtttgcccggtcctatggcccagtagagatgacacaggagaacacggaaacatccaaaatgttcactggttcagagtgtgtacacagtaattttgatgtctgttgcctcaaatacctcctcgatcatcgcagatacattttcccattgcagacgatcaagaccacatccaatcctgaaaaagacaaaatatctccattgatggtaacgaaagtatctaggaaactgctcctctcttttaagctatatccactcaaagcataaaaacaaataatctagtctgacacccttatgggcaaccatggtaggagtttggaagtcaattcttgttgtgagtcaccgaagaccattcctagacagctctaacatccaaaaactatcacttctgtttgcctaataagatactactttccaactatttcatgctacatttagaaatgtgtaactgtcatgacattagagactcattatccctctatgactactgactaaaattggctgtggatggatggtgaaaggttggtattttaaaaatgcacttatggtaacagaatgttaacgaaagtaaggagaagaggaatgaggtacaggatctgcaaaaaagaaagtcaagagggaatgctgggaaatggtaagatagttgcaatccaggagtaaggtctttgcaacaccctggtaagaataaactcagtccataaaactctactacttggcaccttccaagatgttactctagtgatcctcaacacgcctagggaaaaaagagacctaaaattggtaatttcatgtcataatgtgataattaagtccataaggaattgtgattaaaaaaaaagtttctgatatgtatgtacaccataaatatatcaaagaccagtgtaaaataagggacatttgaggccatatgcaaagtaatgtggggcgcaagataaaactgcatgtatgctcagcattgactcaaaactaccagggtgacaggaagaaaagaggtgaggcccatttcctgaaaagaaagcaaagggactactgaaccctcaatgtcattccctaaattcccaatagctaaagtctaagaagttacatcagggacagatcctctggctattacccatactgaccaaaacaagtgtgcagtataaaagggaatgataatttacaactttcttgacgcaaagtaataggtttgggagatgggaagtggtccaagaggaaaaccaccattgctcagtcttgattctttagcttacattgctttaggaataaaggccaagcttcaagcagagggtgctgagaattcaacaaatgtagctgaatgacaatggtcgctctctgctaagcaggctgaggcagatgtatatttcaaggtaattgtcctgattcattcaactcaagctagaaaatggctgtgccttagtctaaagccagacaactggttcactggtggttttacaaaattttgacttttgtccacctttaaatctatattttgggttaagcttttaagttgtttgtctttgggtaagatagtaaaccccaccaatcaattaaatctccatttaggaccatggatttccttgcctgggcatggagaggtcagtgactccattcttcagacaatgagacttcattgcctctaaactcttctgtaagttttcataagttggcttgtgcgaagcccttttctttgtaatctgaacacaaaggattcaaactttcatcatcccaaaatgatagccaaagaaaagtcatcacattcccccaacatcccaataattaaaagagtaagcacatttttatagaattagtctagagcaaggatgacaaatgtcatattgccctttccacactgttatgggagaccttcaagaaaatccactaaatagaggctgagaaacccagactctgccacgtagcaatctttccttttcctaggaaacccatgagattagcagatgatgcctattgtcaatatttttaagcaaggtaggtgaagtctctgtgccacttccaagagataagctgcatatctctaacagggaagaaagcataccacctgaaaattccctgctaaaagcctctacttatttagaaactgtgcttgcttgctttttgtctctctacataaaacaacagaaaaaactggtagggtcccaaagtaaaaccactggaagccacataagctttaaggacagaattcaaaggggctaggacatctccccactcagtttgtcatccagatcaggcttgtagtgggttagctgtaagctacccaccaccaccactaaggaagccacaccctttcagggaccaaatgccatcctggactgttgaagaaccccacattcaggcagtagttaggagaggagctaagtattatttgggactgcacttattattttttgtttttattcacccccttgctatcagtgtgctatttgacatggaataagagaaaagctcctttgggaaatctgtctcttgagacattattgtttttatctcactctgcctaggaaatatagtatggcaggcattcctaacttttgcaagtcttagaacaggcctatggtacatgatacacgactttcccacagagctgggatgcagcctcacatttctttctaacccagtgctccaagtagccgccatcactggactggagttgtcataagataggaagctttttgacattcttagttgtctagaatagaacatcatgatcaacacaaatgcagtgcagcccatctgttcacaaatccttaaaatgtattaagaactggccctgaaaaaaaaaggaattggccccatcttaccaagtaatatatatatcgcccatctctcttcagaacagccacttctccagatttcttttctaagaaaaagttatttaatagtagaaatgaaaaagaaaaccaaacactgatctctaaagattttaaaatgtttacagatctgagtttacctcagaactagaattttcaacactgaagaagggaatagggaagacctattgtctcccacaaacactttgctttttatcagcattcccaaatactatattccttaacttaacagctttcttacagtcatgtttcctcacaacccatcttttgtaccactactacttttaaatatatcctcatttgtccacaaactttctctattgccttgaaattgttttatagtgtgtagttttttacttgccaaatgtgtatttactcaataattatctttttacatacaaagagctgtataaggcattatgaggaatacagatatataaaaaaggaattaattattacagagttttcaatccagagaagatatcatcattccaaataactataatacaaagcagtaagaattgcttttgtctaaggctaagaatcactgtggacactgatgctgttaagcctggaatgtggtcggagaaactgttgcagaagctttacataggattctagtgcacatttctggtttaaagtggcccgtagaaagtgatgggaggggtctgtaaggaagaagaggtttctaaattcctctttgaagagaaagcagaatattggtaagtaaaggatcttgaatgccaacctatagactaagcatctcagagttatttcaagtttcagagaagtacagtaatatcgtcaagaaagtttcatgatacaagaggaagagattaaaaaccttcacaggagttgggttttgatatggtaaacgtctaaactagaggccattcttggggaggaaaatcttaaaaacatttggttcttaggaatcccctctttacacgcatattttattaaagtgtaacagattaaaaggtgctctagccagggcaaaccaggtaagtggtttccaaaactcacgttgatttaaaagttcttgcacccctccaaatttcttcttaaagaggacagctatcccagcgcccatgcgacaatcctcactgatacagtgggctaaagagtctgttttcgggcatgcaaaaaggtctcctttcacataagtgatctaaaaaatgtgcaaaggaaaagacaatgttttattagatacagtaaaatactaagctatttttctgtattttgtgtcccccacgactacctctcccggcaccccttcctccaatctgatttaaagccaaaccaattacagcatgtgtaaaaggaaagtaatggatgatccctgcctagaattttgagcctttttaaagtaaatcagctagagagaaaaaaagataatgcaatcattaatttaattaaaaagtgtttatgcttttgacctccattattacgaatttcagttcaccaataagtcaatagttgttacgcactctgcttccttctggatcttcattaaggctgctggccatgatactgagtcgctatttccagaatttaagtgtttcttcagctatgagaagggaaaaggaagtaaaaatgcttaggcagccttagtatataatattctgattgccctgtacaaccacttaataggcttttttccccaacgtttatcgatgaatgtgagtttgttcggcccctgggacgtaatacaaaacccttctggggcaaagaggaagaacgcttaggttcggaggctgtctcgacccgctctcatttcgtgctttcctggagcgccccgctccgtcagcggaagcaaagcccatccctaagacacgcctcctcctttctccagggccactccggagcaaggccgatttaggacggtctccttttctctgcacgacgcaaaagtatttccccagtgggtctggcttagaagaaaacagaagggacttggccacagtcccgttaagccgcaaccacagagtgtacagggtactggcgtgctgagccccaggcgtggggaaaggaaggcggcctctcaaggaacgttcaccccccacttttttggggggtgcgtgggagaaggaaagagtctattgaagcctcccattctctgtctcctaccctagggcgggtcagcgaggacgcagtctgtcctggggtcctatgggagggtgcggggaggctcgctcaaagccccaacgtacccaagtcacccttcacctggaaaggagtcggttgtttggaggtccccgccccgcggggaagggctccggatccgaccctggtaggtggggagcagcggaccagcccaaacgcggagccaatcccgccaaagcccttaattgcacgcatctaagatggccgcccccgcccggtagcggggcggaaacgagcccctctagcttgctagccgagcccacactctttggcgaaggccgccgaacttccggcagtaaattccgtggtttcccgccgccgcccgcgcatgcgtaacgaaactgccccacgagtcgggaaaagtggcgcttgcgcattagccgcaggggtgtgtcctagtggccacttggaaaggggtgggcagctggcaaaggggctagttagcgcctgcgtagtactaagctcaaggcagcgttttgagttgaagggtctggcgcgtctggaaagcgcctgcgtattcctttcactgggggtggtgtcaaagcgggaaggtgggcgtggcttcagggaacgcctgcgcgttgctcctccgaaggggtggggcgatccctgaactggagttagtgggcgtggcctcagaggcgcctgcgcggaggcggttggagggaggcccgattcccctttgttcgggttcgccattttgctaggcagcggcagtggcggcggcagcggcggctggagcctctgattgggtttcggagtccggtactggagccaatcagcgcgggcagcgaaccgggggagcgaggcacggtgagtgtgaggagccaatatccagcggcccagagccggccccagcgccccgattggcgggtctcgctgaccactcaggagaggcccaggcgcccgtcgagcccggggagtcgagctgagcctagccgagccgggcggccagcggccccggcccggggcctgcgagcgcctcggggcactcccggccgaggcctgcaggggccgccccgcgcggggatggcgcctcggggagcaggcacctcggggctccgaccctcgcagggtgccagggccagttgggaatgcgtccctgttccccgactcaggcccaggttctcaggccccaggcctggggccacgaatggccctacactaggggacacatgcgcgccctgggcctcggcgatttcctcctggtcgttctggccgcaaacttaaacctgcccttgcactctccactctccggcccttgggacaggaagcctccccggggcccgcgccccccgctccccgctcccagcgagccgggtctgtcttatctgcagcccctctaggtcgggagggaggcctggggagggtgcgcgccgcggccgcggggtcccgtgtgcggctggcaacggggctggcccgcccacgcctcggagccctatgggcccgcccccgctgtctccctggtggggagagggggccgttagttcgcccactccccctgctccgccgcgcccctcctcccagcccgctccgcccgggtctccggcccggcgccgttaccaccccttttggctcgtcatttcctctcttccccgccccgttcgcagtggcaggaccgcacacctccgtcttggagcccaaccaagcggtctccgtttcttgtccgggctgtaagaccagtccattcggtgcctggaacctcactcttagaagattgatacccttgcgcattctttccggaggctgcacaacttgctgttcatattactaatcttatccactgctcattttgtgaaatctccctcccttgggaatatagtacagttttgggggttttttttccctttgtttttgccttcgcctttctatgttactttgtgtcaggcttgacccagtccactcatctcttggtttatgtttttctgatacactttcaagtcctgtgttaacgttttctcagcagatgtttagaaactaacagtgttgtggggttttccttagggtgagaggttgctgttggcaaccaattatccagcagttagtatatgccaggtataatccgtgtgttagggagggagtacgtagaggtcaataagaactgtgcctacctgatggaaattgacaggtgaacaggtagttaatacctaacggttagtgctataaaggggccaagttcagttgctgtgaagtatccatgcgtgagctagcctccgtgaaaggcttatcaccaccgcacttttgactggccttgaagaatgatggtaattcttccacaggaaagatggaagagcttgctcgaagagaagaaaagcatgtgcagaggaatcaaattacactgttggaggcaggaagatgggatagggaagtgggcagtagttgtgatagtttaggggggaaagcccagttggtaaaatacttgtatatcttgctaaggaatattttggaaacagttattattttgtatggaggttcaagtagaagggatctagagctatattttttcctaagattgaaaaaacgagtttctgacttgtttatgggttctgccccgtgatagtggctgagttctttggggatgaagaggagacttgtcctaggactctgaaaattatttttactcatgtgaatcatctagtgcattccctggcacataaaggtcttaagtatctggtgcccatttctaaattcacatttaatgttatacaactaataggtttcagaaaactcgtattccagtgctctttcattactaaaacttcggggacaggttttattttcactttttagggtgagtttttcattgttgcttaagtgattttcttaattcatttgattgtcacgttatccgcattagcagatgagatgatagagcttaagtagtctaaaaaacatgtatatttgcctttggaacgtttttttgtttgtttttggatacagggctttcctctgtcatccaggctggagtacagtggcgcaatcgtagctcactaacctggaactcctgggctcaagccatcctcccttcttgttctcccaaaacgttgggattacaggcatgagccactgcgtcctgacctgaaatagatgttttaaccttagtatttaaaaataggtatgttctggtcacttcaaaatcactaaatacttttgcttggcatctttctaaaaggcattataatctggtaacttttttgctaaataccttacaagcttccaccagtctgcagaagaatttctttgtctgacattttgagagaaagtagtgtggccccaagctttttttcctgtttagtccactgttcacatgctgaaatatttctgttcttgtttttatgctctcttgatttgtagtacttcaccttcctccacatcatcacatagctaaatctttctcacacttaagaccagttcatcctgcaggcctctgatagcaaagaaaaaaaaagttcaagtagtacctttttttttttaagccttgttgatttatccccagctggaacaaatctctgtcctccaaattcccatatcactttatctcttaggattccagtataggtttttagtccattactaaacttaaagactctttgaagtttgaatcttcgtcagagatttctttttatttttaaaaccttcagaacagtgtctggcacatggtacataattagtggagagaagtgcattagaaagctccaatccagaaatctgtaggatgatggggaagctggacagccctttgttgtagtctagtctttcatcaagcgtctatcaggacccacttgttgagttgtgaaagaaattgagtgagccaatgctgggaatttttaaataatagaatagaaaatatctgccaggcatgatgatggctcacgactgtaatcccagcactttgggaagccgaagtgggagaatcctttgagctcaggagtttgagaccagcctgggtagcatagggagaccccctctcttaaaagaaaaaaaagaatagaaaataccaaagtgcatcttgtgttgtataaaggtaaatgctgtttcatgaaactttcatttcagttacatgctttatacatgtgtgcactgagttgtgataatgaaatgtgtttcttactaagggttgtggtcaaaaaagttaaaaagctactgttctaggctttgcctggtagtgattatcaactgtgataatcctatggcttttcatatgcttacactagttgagtttctgaagaggttttagctttggagtttgtgtaggtccacatagaatgggttcctagtaagtggttggctaagtctcagcttttgcaccttggaatagtggggcaaagagaattgcactgagaagagaatgcactaggaagagaattttcatgctagccagaataaacacttattatttgtttctctctctttgaggaaaaaccattcaaaactttgtgttaagagcaagagctagacagactaaatctggcttagtttgtcataatcttgggcaaagaggcactttgggaaagactatcgaattgtattgcagtcttgctaactgaagctcacagtagtaggaacatatgactttactgaagccagttgcttatagcattaaccattaacagtatcaatatcatgatacaggctaaatcactctgtcattaatgtgagagagaattgctgctagatttgaagctgctcttcaaatcttgatactcttcaaagtataaatttaaatattgctaaattggttcatttgtattaccagaataaactagttaagaagaaaatctgtacgttacatatattagtcattatgtgcttcaagttatatttagtcttgtaaagatgtaaacttctggatattagtcaaggaaaaaatctcatataagaaggaaatttggagttggggaggcgttgaaacctaaaagacattcctttcatgatccttattttttaaaatcaatttattgagagatactttagaaacaaagtataataattttaaatgtgtattttgatgagttttgacaaatttgtacacctgtgcaactgctaccacaatgaagatataaaacattttcatcaccctacaatgttcctaaggctccatgccagtcaacctccctctttcctgtctccctgtattctccactcccaaggaaccactgatccattttctgtctctagattactgatgtcttttggagattttatataaatggaatcatatatattcgtttacatcataaccttaattttattagtttatagccataaatgtattgtgtattagagacaagatagaatttagggaagcctgttagtgcccctaacagactcacagtctggctgaaaacctgattttctattctatacccagaatctctgaggagcagacttagtcaaccaattccaaagagactggtgtaaaaatcagaaaaccggtttgtcatgttgctgattatatttgctccctgttggccaatctatatgtaaatccaaattatagctagaaatttacctagcgagcattccattagatcaagggcagtgctttggagaaccatatggccacaagtcctcttgctgtgatgacatagcctgttatttatggctcatagattcttatgttgtatccattttggttatgagtaatggggttgattaatttttattttgattaaattttgttatatttttcctaacattccaacattcatttgggaaataagaatttctcaaaattcttattctagaaataagaattttcaagtgtgcagtgaaatcaaaggaatttgaaaataaacacctgtatacctgccagttagggtctattaacatcttactataattgccttaccagatatttctccacccattcatccattttttgatgcatttcaaagtaaattttagatatcaatacacttctttctaagtacttggacatatagttgcacatattttggtttcttctttcacactgtattgagacaccttgcaaatgattaattccaccagcatgtgtggatttatggagagtggtactgtactttgccacgataatgagcagctcagttaggtcacgtcattttattattcagatgttggaatttatgagggcctagtgaaaaatcagagagaaagacctatctacatttttgtttatatatctgtcctccctcccatatttccaagatgaattgccgattgctaacttatatcattttaattttttaatgaagtctttattaaaggttctcagatatcattcagtttatctaattgtatccttatttttaaaagtggatcttcaactcttaaagtctatgagaagggtaaattttgcctaccatatgtagtggacctgagtaacatgtttggtgggaagcaattacgtgttacaacttaaagaagctttattctctaaagtatatgtgcaaacctgaaaatcagtgttaggtatgccttgtatcaaagtgatgtagcttaacgagtatctcttaggtgcaagtattgctctgacagtattgaaaggtaaggttgccagtatactgaaagcattttagaaacgtgaaaatagcattatgttgttatgattgtgccatgtaatcccagttaaaaatgatactgaatataagcatttcctattctcctatcctgttttcttgcaaataaagtacagtgataaattatccaggttaattgtctggtaaggcctttattgacaatctcactttagtttctttccccacctttctaacaggagtgtacctcacagccttctaggatctccagagtggacaggaatctcacttggagggaccatggagcagtatacagcaaacagcaatagttcgacagagcagattgttgtccaggcaggacagattcagcagcaggtatggaagcaaaactgctttaaacattacagcaatgaaactgataacagcaccactcaattggttggtctattgccctggggaattatttgaaagataccagatcttgtgagatattgggtctgatggcttgtgctgaaatgccatgtctagcccatgaccacttagaatctactcttcatgggtgcctggttatagtaaattgcctcttttatctcattttaagtaaaaacatctagtctggttttcagatggaaatttggactttaaaatttttctggattctatttggtctttttctcttcttgtttgagctaacttgtgatttagtaagtctttggccacaacagacaaaccaacatagcttccaataaatcttctgttttttgatttggtctgccacattttttattcagaaaagctctggtttaacattaggataatatttagacagccattcttatggataagacatactagaaaggaattccctgctgctggtttattcctaattaatagattgctttcttgaatttatacacaggttacattttctgatgctttatgcttgggtttattatagtaaaatttcacttttttccccaccccagaagaaaaaaatgtattatgtttctatttgaccttaggccaagattgatattttggaaatactttgttttcaaaatggaatttagctaatatagaaaagtagtagggaagggaaaggtagtattgatgatgagtttttcccgtctaatgatcaaagacgaactcccctgatagctttcccttccatacagctgctgtggctctggcagtttccttcaactgcctttttagaggaagggattccacaaagggccctccattcacaccagtgccctggagggtgggtttttattctttcagaatttgccattagtggatgtaaaaataaggttgaatcattgaaaacatggctcttaaagcagtccagttgggtagaaataatcttagttttgaagctgggcatggtgctgcatgcctgtaatcccagctactctggaggctgagacaggaaggttggcttaagcccaggaattcaagaccagcctgggcaaaacagcaagaccccatctcaaaataagtacataaataaagtttaaaaaaaaaagaatcttagttttgggacatgagagcattgacgtcatgaagatgatttcggttcatagtgattaattactcctcctttcttggtgattgcatttaagcccagaattttttatggtagtttcagggctattaaaacctaatcatttttttcttgtgaactcatctgaggagataaaaagggcattaaacaattgtgtaagtagaagtgtcagattcctgtttctggagggaaagattgcattacaaatctttgtgttaatgatgacaactgttttgagtttttgagtcaaatttttgaggtccactctggagacaaagggctaatatctttaatcctactaccttcaacaaaacagcttcaatatagggagtctgtacattttgaaagtccttcaggcttccgtctctctcctccaagaggtaaggtgatctgtgtcttgaactacacatttccttcctgacatatttcaagctcttcctgttcctgttctcagcagcagggtggtgtcactgctgtgcagttgcagactgaggcccaggtggcatccgcctcaggccagcaagtccagaccctccaggtagtggtaccctctctgattctctgtgagcactgcatgaacttctcctctcctcatgtctggtgctgtttgtgttaggatctccagtaggaatggcaaagtcagttgcatgtctttgatgctgctaacttgtctttgaggcttataagatgccagtttcctaatatttcatgccaagtcatatagagaccccgtatcaactttctgagaattggatttgactagcatgtttctttgagaatgcctggaaaagaaatggtataagtgacaggaagaaattcttataagtgacattagaatttattcagggctcggccgggcgcggtggctcacgcctgtaatcccagcactttgggaggccgaggcaggcggatcacgaggtcaggagatcgagaccatcctggcaaacatggtgaaaccctgtctctactaaaaatacaaaaaaattagccgggcatggtggcgggcacctgtagtcccagctacttgggaggctggagcaggagaatggcgtgaacccaggaggcagagcttgcagtgagcagagattgcgccactgcactccagcctgggtgacagagcgagactccgtctcaaaaaaaaaaaaaagaatttattcagggctcacactctgatccaattaattgcatggtaaaaattttgtgtatttgtgttacaatggagaaggaaatatatacatatacagacacacataaactaggctaggctgtgctttatttttattcaaggggcaactcaactgaaaaataatcattgcacttggcaaggtttatctaagcactgaatcttgttaatctcttgttaactgctattgtttccactacctttcctgggggaatagtgacctgtcttattactagatctgcaaagattaccccagatacctcttggttaggcagaagcaggatgtgctttctgtaagtcttaggtgttaaagccactgtgataattcttggttaatcaatacagttctttagcatcgtgtatggctaagtatcctaaattgggttctaatttggccagttcctataaaacacaggagtagcagcactagtctactctgtgtatgtaggttacttttattaaaataactctatttttgagaaattggcaagatttgggtaccctactttttccctccattgaattagaaatgattcaaagtagaatctagaatgtagaactggcatctcactttattgctagtgctgctaagcatccagcagataactacctcttattgtcatcactttatcctttcaatcccacccctacccctgccaccaatagtgtttggtaatgatgtacagccaactttgaacataaattaagccgaaagaaactgagcttgtaggcattccaaaattgtgttcaaatctcacagtccaacagcttgttaatgtttttcatgcttgcttcatcttactcatatataaaacagtattttggattgtcattaaccccttgtggaataggaatgtaacatgctcttaactgtatggcttcttgtttgatgcatgtgtctttgtaacatttttctgttgtaaatacagtgagctctttggagtctcaaatcatttatcatgtgcacgaatagcacatcaattggggaggaaattaagatgatgaatagatagaaaattattaatagctgtatcttaaaacttgtgtttcctacttacatagattttatttaaaagaagtggaaacactttatggaaataatagaaacctttcctctagggatctgattattttgggagaattttaaatagttattttggttattcttgctatatgtattctgagaaatctttcttgatacagaatatgcaagcatttggtgtagcaaaggggatttgatttggaatggggaaataagggaaagagatagcatgagagagtcaggctgtaaagtccttaaaaaagtaaagtaaaggttctcaatggacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctgtgtaatttcaatatttgttgttgcttctgataaagctaaaataaccatgtggatattatagaggccagtgaggaattccaccatggagactgcaaactgaccagaaagtgcttttaagaaatctttagtagtgagtttaaacaacaaacatatctagaattcacagagtaaaatgagcaggataaaggtatacatttgacatttcattttagcttgagagactgtagggaaaaaagggtcatcctctacataagcttccagagctgcttgctacccagcctcctagagtcattgctgggtacagtttgatttaccttcttcactttatttagaatttgtactcaaccaccatcaccaccatcacctttccctctcattgccttctctccagccttcactacagaccattcctggattggtttaaacaggcaactaaccttgccattatgattaaatgtttgtcatggatttagcccgtgtttggtgacaaatgccttatatctattgagacttctcaaagactctggatattctccattatgtctgaccttaaagtattgagcttggcatttagtaacaggattcatagatatttaaagataacttgaggacttgagacatatattttcttagtcttttctaccttttccttttctagcaaggcagcagaatagttccagtgattgtcttttggtaaaaaccattttgtgtcttatgttatttcattgttcttattttatttcattctaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaagtgagtaatatttaaaaatattgagcagtatatcagaggagaggtttcaaagaatagattattacaacctatttgataattgatattgcatttaactgcttcctaacccacattttgcattcagttgattttctgcctttatagtaccagtgatataaactagaactatgcagaaattggacagctccagtaatgactaagatattaggcatgatcttgaattgctgtaaagtatatgaagaggttagaatctagtttatagtatattttattttaaaagaaacaaaaatgagtatttagaaagttagaaaaataacaaaacgagcaaaaagtgggtccaaattaattaagtagaaaactgacgtatagaaaggataaataaaatctagattgtttaagcagaccaataaaacaggtaaatccagttgaaacactgattgagaaacagaaaacaaaagtaagcaaagatgtagaagagattaaaggaaggccaggcgcagtggctcatgcctgtgatcccagcacttggggaggccaaggcaggtggatcacttgaggccaggagttcaagaccagcctggccaacatgacaaaaccccatctctactaaaaataaaaaattagccgggcgtggtggcacgcacctgtaatcccagctacttggggggttgaggcataagatatcttgaacccaggaggcggaggttgcagtaagccaagattgtgccactgcactccaggctgggcaccagagcaagattctgtctcaaaaaaaaagaagagattaacagaaatatgtagaaatgttacatacaactctgtggcatcatattttaaaattagatatttctcatcgagatggcaaaaaaaaacaaaaagtcattatatccactgttaggatggatgtggagaaaaagaattaatcattatttttggtaatttaaaactgtagagttattttggaaaggcacctcactatctgttaaatacaatgaatatttgagctagcagtcccacttctgagaatctgtcctataggaagaaaagcatcaatagtagggggaaattacaaagacacttttcatagcattgtactagcaaaaaataaaattgcaatctgagtgtccattaataagaataaggaaatggttggaataaatcataatatattcatagggaatattgcatcatcattaaaagaaatgaactgttgacttggggtgggttaatattgaaatattttagtggaaataatttgcagagaaatagtgtgtgatctcatctttgtaattcataaccaaccccccatgagtatatgtttatagtcatggaaaagagagtatgagataactattagttactctatctaaatgtttatattgtttcaacagttacagcagtcatattaatgtcttagttttctggaggaatttaagttgaaaaaagcagccatgatcccactgctcataaatcaaacttgtactttttgtgtattcttttgtgtttttatgcataatttttgggcataattgtaccatgcatgtggggttgtgttttcattttttttttttaattctttcataatgttcagtcaacttgatgaatcagaatttctaatttataaaatatagttaaggattttggttttcatttgcctttgtaggtaaacatttgggcacgatagttttatttttcaactgaattctcaggataatttctttggattggggattgcttgggtaaagggtaagagtatatttgagcccactggcatatttttgccaagatagaattgtacttgggattaaaaatagttttcacatttctctttgcataaatatatgaggctttaaatatcttttcagcatgtgctttccttgattccctattgctatatcctttctgttcttctctctttgcttcctctccagtcccccttgctgcgccttctccactgttgagtagagacaatgtggtatagttaggaacagtatactgtgagtgtagtggtccaagctttcattaccaggtctgccattaaataagcattctgatcttggccaagttatttaattgtcggtttgctcatccaaaaataaaatttatatgagatgatatctagggttcattctagctctaaattctgtgatttttatggggttttattttgctataaggaaccttcaaatagttatttccctgcttccaagtagggctataactaaccaagctgaaaaaaatatattctgttacgtaaataaagctctctaggtgagattccatagcctcccttacaatacttaaggctttaatcccctttgtataggagttttttttctcattagtgttgagtagccattttttaaagaagactacttcttaaccttttttgaattgtattctctattttagaatcctagtaaagcttgcaccctctaagaaaaagtagagatgtccagtctcatgaaaaattctgcatataattttagattaaaatccttggcctgagaaagatactggaaccagagagacagccaagaaatagatagaagaatattggaagttggcatataataaaagtggtataaacatatcaatgaagaaatggctgaagaatgatacagaaaagaaactgatttctaattcatactgtattttaaaaaatatttgctaggtggattaaagatctaaatgtagaaaagtaaacttggaaaattcaaaagaaaatataagaatttttatgctatagagaaggatatttttaaaaacaaattgactaaaacataatatgcattgaaatacatcaaataaaagtaaacaaggtgaaaacttggaaaagatatttttaatacatacaaccgagtttgtattcagaatatgtataaataacgtttatgtatttatacaaaaataggaaaatgggcgaagaatatgaatagatggaagaggaaatcctaacagccaatataaacttagaaatgaagttggttcacataaccagataaatttgtttacttatttatttgccaatactttctgaatgccaattatgagctgagtatttggaaaaaataattcagaagacctaggcaatctatcccctaacaaagtaggatccatgaatgtctctaagacatggaacccattgacctgtttttttcaccttccttccatcagtagtcctttttcctatcagctggtagactttgtgataacttaaggttctaggcatgttcttctttccagaccaaggtggtcccaagttgaaattatggatggaaagtgacctggctataaaaatctatctttctgaaagtatcctccttccagactgccatctatgttgaagcaatgctcaaataaaaaaagtttgttgatggaattaatggtcaaagaagcaaagagaaggttacttagtactagccatgtattctggcttttaagtttgggaggtattcttgaatataaaatacaagacattttgagctatggggctctcctcactgctttctcttttgcacttaaaaaaaaaagtgttcactagttatatgaaaataggattttgtacacccaacatttaaagggttgtattgcagttttttagttccaaaatttagagaaatatttttcaagcttcttgtcaggtttctgataacactcctaataaagtggctatagccattaaaaaaaagaaagaagatagatttggatagcacacgatcccttgctttccataattgctttataaggtttagctatccaatcctaggaccaaataggagatacaaattaaatcaacaaaaatttgacaaacattaatgacagtagtgagtattggtaattggaaactaataggaggaatataatctgtcacattgccttaattatctattaccatataacaaattatcctagaagttagcagcttaaaacaacaaacatttggccggtgcggtggcccacacctgtaatcccagcactttgggtggccgaggcgggtggatcacaaggtcaggagatcgagaccatcctggttaacacagtgaaaccccgtctctactaaaaagacaaaaaaaaaattaagccaggcgtgatggcggacgcctgtagtcccagctactcgggaggctgaggcaggagaatggcatgaacccaggaggcggagcttgcagtgagccaagatcacaccactgcactccagcctgagccacagagcgacactccgtctccaaaaaaaaaaaaaaaaaaaaaatttattttatagtttctgtgagttaggaatcctgacacagctgtgttggattctttcaaggtcctctcaaggcccttatcaaggtgttgtcctgggctgcagtcacatttgactagagtagaatacattttgggttttttctttgtttgtttttttgagacagttactcgctctgttgcctaggctggaatgcagtggtgcggatcttggctcactgcaacctctgcctcccaggctcaaatgatcctcccacctcagttccccaagtagctgggaccacaggcatgtcctaccatgcctggataatttttgtatttttcagtagatacagggttttgccatgttgcccaggctggtctcgaactcctgacctaatctgctcgcctcagcctcctgaagtgctgggattatgggcataagccattgtacccggctttcagcatttttaatatatatagtatttcctctgtaaaaaagtacttcatcattcaccaaaatggcaagattaaaaaataataataaagcactttagagtgtattttatttttttatttttttgagacggaatctcgctctgtcgcccaggctggagtgcagtggcgtgatctcggctcactgcaacctccgcctccggttcaagtgattttccggcctcagtctcccaagtagctgggattacaggcatgcaccaccatgcccggctaatctttgtatttttagtagagacagggtttcatcatgttggccaggctggtctcgaactcctgacctcaagtgatccacccacctcggccttccaaagtgcaaggattacaggcgtgagccaccacacccagcccagagtgtattttaaatatgcatgcttttcaatatatataatcataccactgctatctttcataaaaaccgacattgatttgttaatatcaggtatccagacagtgtcgaaattccctatttgtttcataaatggaaaataagttgtgtctacttcataatggagggcagagcaggacttcttttttcctcttcagaacattttctgctttctagagaaatgtggataactctcggggaccaaaggagaccagtgtcagtagagtacaatcctttttttatgttcttttctgcagatacagttggtcccacctggacagatccagatccagggtggacaggctgtgcaggtgcagggccagcagggccagacccagcagatcatcatccagcagccccagacggctgtcactgctggccagactcaggtaattccactagctctgtcacacaggagcaaaactgatttggaagagtcagataactgagtcagatatttcatgtatagcatgtatagtagaaaaggggatgaaaaccataaaaaaatatatttttggccgggcgcggtggctcatgcctgtaatcccagcactttgagaggccgaggcaagctgatcacaaggtcaagagatcaagaacatcctggccaacatggtgaagccccgtcaaaatacaaaaattaggtgggcatggtggcgcatgcctgtaatcccagctactcgggaggctgaggcagagaatcgcttgaacccaggaggcggaggttgcagtgagctgagattgcgccactgcactgcactccagcctggcgacagagtgagactctgtctcaaaaaaataatttttttttttaaggactacatcgttctttgttagtatctttgggatctgttgaattgtgtcattacttatttcctccagacacagcagcagattgctgtccagggacagcaagtggcacagactgctgaagggcagaccatcgtctatcaaccagttaatgcagatggcaccattctccagcaaggtaagtgtacccataagcttccctaggactttttggggcaacttttttgtcccttagacaactgacatctttagaatttgagtggtgaacttgacactacatattttttggacaaaaaaaaaaaagatttcctctagctctccattgattgttggtttcttgtcaccatctgtgaccaacagtgattccatgtgtagcagtttctatagtggttgctaatctagggattgtgtaagcttttagggaagaagtgtttctaaacagaagaatagaaatagggagttcattggtaaagagagaaatagatcaaaaatcaagttggctttagagtgctattgctgcttatgtttttttctgggtcattccattactttaaatgactattatgtatacagcacttttactaagaagggtcctcaaagagcctctagtctagtaagaaagacgtgaacaaataaatacaatgcagggccctcatggaagtatgttctaggaatagataacataaataatagatgtttggtctgggaggaggagtgcagaaactgaacttgaaggcttttggaagcacctgttagtcaaatagttaaatcaaaaaaggacatctttgttagattccatgactttgtgattgcaaatttgcaatatacaggatccagagagtgcactaactgtgtgctcttgtattactccagggaggccctgaactggattgagcccaggcaagagctcaaacagaatggtgaacaaatcctcaagtgctgctattgatagtctggggacttggaatgcttggtttaattttaagttttaatactacaactgactcattgtcagtttgagataaacaaagtataagttttaaaatctctgtcctgaagcagattgctcattatgtacaagagcagtaggtatagctgtagtcagactgacctgtagaagaggaggcctccaaaccttttcaccttttgaaaactgctaaggatagagttactcaaaactgggacctagacagttaatagaatttcaaagattgtgattacttagattatatatagcacaccacagtgggagagtactttttctccccttgtgtttttcagtgtgttttgccaggatcggtgagtgtataccagatagaagagggactaactatgttcccttctttctgttctgtgtgcctgttttttgtttgttttatgttttgttttcttaaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatggtaagaaaatgtatttttcagctttgtctttgaaattttcttgaacatgcaacttgatgcctcctaaaatttattatgttgacctcttgggattgagatcgatccttaaggcactgtcggtaatctactttgacaataacattatgacaaaccataattcattctgagcacctactatgtgccagggactattcaccagggactattctagatgctggagataaagcaatggataaatagtgattttatggaattcttttcagaattcaaataacgaagggaattatatactaatctttgagaagtggaaagtagtattgcccatgatggacaaaataagaaataagctaaaaattagaaagattgtaattgatagagaaaccaaaaaaaaagtgtcatgtaaatgtattgggaagataggaagatttgggtggtgtaactgaaagctaaatcctcatatgtcaaaataggatgttaaaatgcataaattaagaatgagtaacagaagtctgcacagaggtggaggaagctatgaaaagaaacagaaccaaccctggctcagtggcatgcacctgtagtcctagctacttgggaggctaatccaggaggatggcttaagtccaggagtttgagctcagcctgggcaatgtagagagacctcgtttctacgaattgaatgaaaaataaataatttttataaaagattcaatacagttattcaaagcggttgtatttgggaaagagctgtggggtacaggactctgttacttgtttttacctacatttagtacagtgttttggtgttttttaagaaaaattaggattgaattataagttaactattatttttataaatataggcatttagtagcacttggtctatctatttttgtgctgtttttttgtcttatgactactgttcctgaccattagatggcagcagaaatatctagagccatgggtggacatgaattagggcatggttatatagtttctcagagtggcacctgaatctcctatgacacagtcatctggggtgtttgtttaaagtgcagatctttagtataaatttctccagggatccgcatttacccaagtaccctataaaaattactttttgtggcatttacaaaaaaaatggatgaagaggaaccaagaaactgtttctatgtccatacttcatgccaccaataagctctggtttcctgttcacacagatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaagggtatgtataacattgggaaggatataggaaaggagaatagcagggttctacttttgaaattatcttttatatggcttgttttctcacgtaccttccaaacaattgacgttagatacttgttgtctcttttgtaagagttagcatttgttattactaatatgcagctgcagttataataacgaaaacaaacagtggcttaaataagatgttattccttttcatacataaaagtagtccagagataaattatcctggactggtagcacattttcacagttctcaagacctgtttcactgctttaatattgctagtgtgctgttcatggtccaagattcctgcttaggctccagcctaggaagaaagggaacaagaaaggtaccctttcttttttttttttttcctgagactcagtcttgctctgtcatccaggccggagtgcagtggcacaatctcagctcactgcaacctgcaccttccatgttcaagtgattctcctgcctcagcctcctgagtagctgggattacaggtgtgcgccaccacgcccagcttatttttgtgtttttagtagagacggggtttcaccatgttggccaggctggtctcgaactcctgacctcaggtgatccacctgcctgggcctcccaaagtgccgggattataggcgtgagccaccatacccggccaggtaccctttctttcaaggaaactttgaagaagttgtgtaccttccactagccggaatttagttacctgatcacacctaacatgcagataaggctaggaaagtccagcctggtgtggtggcaaatgcctgtagtcctacttggaaggcagaggcaggaggatcacatgagccgaggaattcaaggctgcagtgattcatgatcatgccactgcagtccaacagcaagggtgtcagagtgaaaccctgtttctagaaaataataataataaactttaatgctaggaaagtctttttactgaacactcatttgctcaaacgaaatttggcctgttattaaagcagaggaaagtgtatatattgtgaagtgtaggtggtagtctgttattttttttaaaaaaaattcatactataagcattcacagtcttacagtagttatatatggttagctatattacttactaggtgttttctccaaagcttccatcgtcattctaagtcataattgtcccttgtgactttgatcccagctgtcttaaactttggagaatggaatttgtgcactagataactgtgctggttctggatagtattaatagttaaatggttttatttctcgttttagaaatacctgcatgagtctcggcaccgtcatgccatggcacggaagcgtggtgaaggtggacgatttttctctccaaaggaaaaggatagtccccatatgcaggtaggaagacatatacattttattcttctctttattaccttgtattgacttgagttgaagccttcagcagtgtcctcttgctattttcctactctgggactactcacattctctaaactggatgcaatcttatgtctctttagattatcttttatcttaaaaccactaggccagacttggtggctcatgcctgtaatcccaacactttgggaggctgaggtgggaagcccaggatttcaagaccagcctgggcaacatggcaaaactccatctctacaaaaaaatacaaaaactagccaggcctggtgatgcatgcctgtagtcccagctacttggagggttgagatgctcttcgtctttgtcacttattactattcattctttcttgaaaatcacacttttcttaattttcaaggaacaagttttatttttattgaacaggttttattaccccatcacaaatataatttgaatgtttacttttttcccttctaactgatgtgagcctggtctaatcctctcttctttggcttagatttataaaatagctgcttaatttggtttcccttcttccacttttgttcccctctagcctactctccacatcctagtgtgatctttttaaaatgtttatcctatcaagtccctgttctgctcaagctccttcaacccctaccctttcccatttgcacttagactgacatccaaagtgcttactactatgcccagcaaagccttacatgctccagctcctgtctacctctaactgcatttctacttcttggtctctatgctgctgtttactgttcattggtctacttcctgccacgggtctttgtccttagaattttcagtctgtatgccctttatctttttcatgcatgtctatctccctatctgttaggtctgggtttaattaaataccctatctagaatagatctcttctctctcagtatgttcttacaacatcttttctttttttggaggcagtggtgtgattatggctcactttagtcttgacctcccagctcaagtgatcctcccactttaggctcccgagtagctgggactatagccacgcaccaccatgcccagctaatttttaaattttttgtagaaatggagtctcactttgttgcccaggcaggtctcaaactcctaggctcaagcgatcctctcgccttggcctcccaaagtgctaggattacaggcgcacaccattgcacttggcccttttctttacagtgtaataatatttaagttgttgaatttttcaagattgtttccttcactagactgtaagttgtatagagggtagaggattgtttcgttctctgttatatttattggacttaattctatttaagtaagttgtatttaagtactgacttagatgtatttgttgggtttagtatccagttctgaaccaagcaatcagtgtttcttgaattaatagattcctcccatttgctgatactccattctatattaacatcacattccacttgcactattgcaatatccatcaaattaatctccagtctcctctaattggccttatatagtacttatacagtacatggttaaagtgttttttttaacctgccagtccccaggtcaaggatgcatgctattaatagttctcatttcttaactgcatcaaatctcaaactatttctgtataacatctaagcaactttgccttatcaccccctcaacaatcaaactaggtttcctcagtgtccccacacatgaacactaacaactctttcagtgctattaatcctcacctgtagtgtgagagcccctcctttctcattgctattcattcataacggtgtatgaatgtgggcctgacagctattgtggcaggagggcattgtgccaggaactctcctcattctgtgtgctaacaatatgatcttggtcaattcagcctcttttatttttatctgtaaagtggaatactgttgatacttcacagcaatgttgtagggatttcattcagtaatccacattaggcatctgtgtagcaccatacctagtgcatggtgagttcagtaaatgctagttgtttttgctcattgttcaagacccagttccagtcttccatctccagaaggctttcagctttttctcagatcctgcctaccaaggcttcagagccttggtatgggggaactaaaggtggttcttgcggagtgttgcaaaaagcttccaaggatttatccttgtgttaacacggtaggtcttaagtgagaaacagcatatagagtttagtggaaagaagatgaaatgggagtcaggagatttgggagttagcccttgctggactcctaactttctgaccctgaccctagtccacgcaaatcactttacccatctggccttcagatttatctgtaaaacgagtacattaaagtgtatagattctaatgattctttctagccctgctaagtactcagtatttaaatgatgatcaaaaaacagtgacaaaaatacagcatgacatggtttctctgggtcttttccttagacacctgaatctgaatactcttaacccttaagtatagagaacaacacaaggttcttaggaaagagatacactaacagccctgcagtgtttcaccatggagtgcaggccagactttaaattattttaagaataaggtttattgtctcttctttcctaatggggctacactttaagccatgtatgcagacttaagatgtattacaagcctttgatttacttggtaaagttatgtgtattctcttggggggataagtagtgagagccatgagttcctgttgcttttgcaaaggactttaatcatcatgtcatctttgtctctaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgcttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgctactactgaaagtgtttatcaaaatgtgatgaagtaattccatgaggaaaattagccgttatcacaaaaacagccttaagtattgtagaatttcaggtagtgaagatgtactatttacgttttgttagattttgttttggcagaagaccaaaacaaaagtacttttctgattgttaaaaatccacagcatgctcaccttgttactgttttaccttacggtcgctgggaatctaagcaacaaagactagaagcctccgatatgccattatcaacacacaagagacaaacagcccgaggaagcactcaatgatgagagcagtagacctgccctggcagatgagagaggagaaactctccacaatgaaggaaaagcactgacagtatttgatagctttagtcaaactgtgcttgagtttggcttagatttatgccagtggaacctgtccttaccaaattcagagatgacccaagattctactctgtggtatgagggaaagacctctcgatatttatctcacaccaacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgcttccgattggcgttgtcccaaggaagcctgcgcggattgatcggcggcaggcctccaatagagcctgctaggcggattggctgctacgcggctgggccctgtttccggtacctaggcgggcagccatggtgaccggcgagcggcatgcgacgccgcctctgtggcctgtggaggcccgcttggcggcgctgcttcccgacctactggtctttcggaagcctcggggatgggaacccgagctcgccacggcccagggcgtcctcctaggcgtccatgtgacgggtgagggcgacggccggcacttgcacttaagtctcctggcctgcgggagaggcggccgttgggtctaagcccctggaggcctcgacggttacaggcctagcctcccgcgagctaaggcacagtttaacttcgtgctgcggcttccttaggaaactttgagtatcttcgttttagcgtgggaggacatcttttgggatgaaccggctcagtccttgagctcaccccaaagatgatgaaattgaaactcagaggaaaggatttttacaggaccacgccccgggctttgaacccgtttttcccaaccccgagcattttctattaagcgttctgtttcaattattttattcgttcagttaattcgttcttggcgtcataagtatatgcccgccgttgttctggccgtagctatctagcagccactccgcgagtcgttcatttaacaaatacttactctgtgtcagggatatgaagatgggtaataccaggtgcctgtcctcactgtgtgagtggttctctagccagacatgaggagggatcctattgtttcccatagctaggcagcctaagagagtaggggaaagagctggctccagatgaaaagggcaccatctccagctcttggaagcagagagggtggtcctttggattcccagtggcagcagcaaccaacctggcccttagtagtttctaagttacaccatgttaatggataaaggaattactcagcttgaagggatctgtttcctttacactggcctgatgtgtggggagaaaggggccaaaaagtttaggatttggagttaacatcgtaatttctgctttgttggtcagggtttacagcattaatggacaggttcaccctgacctacaagtcggaacgtgacatggacaaactggcccatatcttcagttattacattagtgacatcgtggagcgtgagtgatcattgtagggtaacaaggtgtggtgctgggctcctgggggtttataaaagaagggggccagaagtactttaaaacaggtaccaaagggtcattcctttagcatcattcatctttggtttcttcaagttgccactgaaaagctagacctttgcctattatctgctaatctacccagtctcacattctattgactcattgttcaaagggggggcaggaggagctaatttcctttgcacatttgtattttatttcaaaataaagtattctcttctaacaataacgtatctcaagtgtgtattcagacaaaatttataaaacatctttttattattatattttgatcctgtgaggaaggaataggtgttttcttattttctgccatgtattaagcttttagatatttgccagatatccagtatctggaaaaaactcatttatgtagtacccatgttttgagtacctaccctgtgacatggactgtaataggtgcaggcagggcaagaacccactcttgaactttttagttaggcctacccaacagaaattactctgaccttataccttttagtacttacgtaacattctcatcctttactgacagtgccctgtatgcttccgtccatcattctgagattcaccagaataattactttgaggcatctccgttaagaatttgattatttgacttacctcttatccttaaggaacacatggaaggtcgtttgctttttcttataggtttggatgaaggggaagataaacattctatatcgtgtatgtactctaataccagcaacttctgggtactagaactacaggggaaagtaagacagagtaccctcgtggagtttccattttagtgggacagacaataaacacaataattgtagcttatatattctatcaaggaaataaacatagtatagtggtaaaaaaaaaacacaaaaaataattttagggtaggggagtatatgagacagggtggtcataggctcctctgaggaggtattatttaagctgacacttgaaggatgaggggaacagcttgtgaagaactaggggtaaagcatttcagacagaataccaagtgcaaaggtcctgagacaggagaaagctcggcatgctctaggagctaaaagaaggccagtgcaggccaaaacgtagctcgcagggtgaagagtggtttgaggcaaggttgggggatggtagctatgagaccaccacgctctgtagtccatagtgaagagttggaattatatatttctgtataaaggaaaactgtggaaaggtctagcaggggagtaatatgatctgattaacactttaaagctgattttggctaccttgtggagattgaatgctggtggaaagtgaatttaagaatagaagctggaagaggcaattgtcctggaaagatgttggagatttggtctagagcagtggttctcaacctcagctgtggttgcctgaggagctttttaattgttttttcttttttctttttttttttttgtaagagactggggtctcagtatgttgccaagtttgtcttgaactctagagcttaaaagattcttctgcctcaacctctcaaatagctaggactgcaggtaccataccaccttgtctaacaaaaaatcttaatgcctaagcttcaccccaggccatttaaatcggactttcttaaggttggcccaggaataagaccttttaaagtttcataggcaattccaatgtgcggtcaagactgaagattgttggtgtagaggtatggcaggggagctgtgtggggtagattaacctgaaatatattttgcaggttcaacagacaggagttgctaatacgttgaatttcagtgggaagtggtgagaaaaaggactcagttttttggctttcataaatgaattgatcgtgtcatttaccaagacaggaaagactgaacattgagaaagaaaatcaagagttctgttttgagtatgttgagtttgagatgccaataagtcattcaagtggagaatgactccattcaagtggagaatccagctatgattgagcctggagctcagagaagagatccctgttagagatgaaaatgtgagttgatggcataaagtgggacttaaagttaagaaccgattgagttcatgttgggagagcataaataaagagaaagagcctttggctgaggcttgaggaactccaggggaggattatgataagggagaaagaacctgaaaaagagactacaaacagccagtgaggtaggatattgtggtgttcctgaagccaaaggagaggtagtgtctctagaagaaagctgcagctagctgggttgaaaatgacagctgtcaagtacagtgaggtcagagaggtattgaatttagcaagattaatgctgttgatgaccttgataatttgaagtggtggaggtagaagtcagagtggagtaagctgagaaaaagaatgacagagaaaacatttaagaggaagagtaaatgggagatgaggaaaatatatatagccaacttttttgagatttgggggttttgtttgttgtgaatgtagcaggaaaaaaaatggagctaataggcagaagataaggtagaaccaagaatatgtgggttatttttgtgtgttttggttttgttttttaagctattgatgagaatatttcagtagagagattaggaacggtgtgaagttcttgagaaggtaaaaggggataagattcctatcacaaatggggtggctttgaagagagcaggaattcttccattttagaaacgatgtatgtaggtgcagatagatttggggagaaaatgaaaagaaggaagaaggagcctgagtcttggagtgagcaaatggacaagaatgatgtcaggataaactcagtaggccattcttttgaccatatatgattctgccctgatctggtttatatctgattttgactcattttcctctctcttccttacttgatttcagatgttctctgttttggaggggatatcctaaatatcacaggtatttttttagtttttctgaatacttaaaagactgagtgaggaggactatatttaggtggaattcagcatattggtttattcagcattgtttgattaataggtactggaccctggggatacaaagatgaggaagacatagtctgtgcctcaaaggatcccccagtctaatggaaaagctttgcccaaattaaactctcacatgctttgcatttttgtttagattgaaggacagcaaaataagtgccaataaagcgttcttgagaaaactaatgagaaatttggtcattaatagcagaagctaagcatgagatggggaggagttaagcatgtcctatctggagaactcaggatcactaacagctgtatgccccggagttggcctgtcttcttatttaaacataataaaaccagccatcaaattagatatgaacttgaacccacattttatgaatcttttgctagtacctctcctcctctgttagtatactggtggaaggaagattaccaaaaatatccttaggatcatttaaacttctacctagttacgtttttactgaatgattttgaggatctgaagcagtattttaacctagcataatgtatacagccaagaaaccttgcctgataacttacttgatatccacactgggtcaagttgatcttctgcattactgggactttgccctggaccaagtaagtctagatatttggtccccatcagcctatcctgtgtgtctgcagggaacatgctcctggcactctggagagtagaacaaaatcaactgagtgacatcattaccttggtggcaaaatgcagtctggagatacaggagaaatttgggatctatcataccagggaaggccaggacctgcagttaaagataggtagtacctcctaaaagagtgatccagttgggcaagggggaacccactataaaaacctcaaaagataaatgataaactgggaaaaaatgtttgcaattcatatagacaaagggtgaattgctctactagggaaagagcacttagaaatcaagaaaacaatagtactcttaagagaaaaattggacaaaggacatgagtaaattgtatatagacaaggaaatgcatgtcttttaacacgtaaaaagatgatcaacattcataataagaaaaatgccaattggaagtacactgactacctgtcttacctatagataggcaaaacttcagatgctggacaatgtactctttggtgagtctgaggaatgagctttttcttactgtgagtgaacaacggtataaggtgatttggcaatctttatttatttttattgtctattgtattttttatgtcaacaaaaactaaaccatataaaaatatatattaaaaagtcttgttttcacttatataccatctatactatttactcttacaagtgcatttattccttaacctagcaatccttctggacatctataggtatacgttcacacatctgaaatgttgcatgtgcaaggttattgattgtaatatggtttgtaattttaaaacattgaaaactatttataggagactggttaagtaaataatatgtatactcaataagattacctgcaacttaaaaaaaataagatgtcttgatatggcagtatctccaagatacagttaagtgaaaaaaagtaagatacaaaacagcatgtttagtatgctaccatttgtgtaaggaggaaaataagaatttttcttatttgtttatatctttttttttttttgagatggagtcttgctctgtcacccaggctggagtgcagtggcgccatctcagctcactgcaagctccacctcccgggatcacaccattctcctgcctcagcctcctactgagtagctgggactacaggagcctgccaccacgcctggctaatttttttgtatttttagtagagacagggtttcaccgtgttagccaggatgttctcgatctcctgacctcgtgttccgcccgcctcggcctcccaaagtgctggaattacagacttgagccaccgcacctggcctatttgtttatatcttgtataaagaaacactggaaaaaatatataagaaactaataaaattactaatatcaggaaaatagtaaagatggtcatgtaggtagaagcaagattttaaaatacatattctttcatatagtttagtttttgaactatgttattgcttgacagaatcaaaaatataatacaatataataaaaattaaaaagctacatacaggggccaaagtttcaccaatggcagagtcaggattggaggcgaagctcaatatacaaagctccttcacaagggttcagaaaactcctcaagggcaaaagttggctccagctattcttttatgttttgaggagcagtggtaaaggattatattctgtcttatatggcatctcttttgtcctgccgtcttttttgtttcttttggtttttgttgtattaaggataattgatactatacattggcatatttatacacttttgaaaccatcaccacaataaagatagtgaacatacttatcactcaaaaagtctcctcgtgcccctttgtacattcttccactactctccttcaccatctccagacagacaaaatgtccatctccaggtgtattatataagagaaggaaatctgggggaagaattttttttttttttttttgagatggagtctcactctgttgcccaggctggcatgcagtggcacggtcttggctcactgcaacctccgcctccagggttcaagcaattcttctgcctaagcctcctgagtagctgggattataggtgtgcaccaccacgcctggctaatttttttttttttttttgtatttttagtagagacagggtttcaccatgttggtcaggctagtctcgagttcccaacctcaggtcatctgcccgtctcagcctcccaaagtgctgggattacaggcgtgagccaccgtgcctggccgtaaggtattatttttaaaggttagctcacctaagacttccgcagctgagggcagtaacaagataggcatgatgcacagagccatgtggggattccagacccctcctgttgcatagtttcccagttgaatttgactcttctccatttatctcatttttttctggataggtctacctgcaagtcggatttcccaggttattgttggagatgagcggcagcaatacctcttggtgattgggcaggttgtagtgatgtccagttagctcagcgtttggctcaggcgaatgaaattgtcctatcctggaactgctggatgctttgcaagcagtatatgtttgaagtggcaatcatgagggaggatgaagctgtgaaggtaggaggctagcttcctgtactgccattctgaaaaggccttcctagtacacagcgcaatgctctggtagtgttcacatattgcctggccaaaccaatgaccattggaactcaatttaggagggaggctgggaatattctcctatgaagatagatgaggtagaacagtgaggctgaggagataaaaggcaaacaagggcaatagaatcctcagcctttcttgtgtgggggcacagaattaaacagtttcctttctgtagttaagagatatgtggatc

SEQ ID NO: 563 - DNA, 9009 bp, Homo sapiens
cctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactgggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactgggaaacttagagtcatgagtttatgaggctggatttgggcacctttcctttgcctttggttcactgtgagttctgatgtcctagtgacttaggtcttagaagctcacgccttagtttgaaacagattctccacggtggtccccaaaacactgtctgcatatccataagaattgaacgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 564 - DNA, 621 bp, Homo sapiens
tttttttttttttttttacagtttaaagaaagttttatatatatatttatatatattttattataacaaaataggcagctattgtgggtaaaatattcagtaaaatctgactcctaagaatacatttgaagttttaggctatgaattggactcctttccattgccatgatggttactacgtcaccactgtaacgtctgatttatctgtatttatatctaggaaattttctcaatcttctgtgtaaaaggcgaacttccttagcacctgaacatggcctcaattcacgaaatgtgatgatcatttacatatgaacaacttttgtaagacacgatagtgttgctcaagtagattaaaaacattgaaacgttgttattcctagcaaatgtcctgggaaaaaagaacgtcaaatactaaaaggctttaagaatgttgaggaaaaaatgaaatcccttatgaaagtcaactcagacatgaatttttaaattaaaaaatgtccttatttatctataatgaaacaattgctttgatgatagaagttgattgagaaaaggattgagagtaatacactggccaaacatgctattaaactgaagcgtgcacattgctcaaatctactaaat

SEQ ID NO: 565 - DNA, 110605 bp, Homo sapiens
gatcatcagagtgacagaatgagaagccaccatctggccaccatcacgatcatcatcacaatcacgacgagtcaccaagagactaaaactactgagtaaaagcttagaaacggctgggcgcgctggctcacacctgccatcccagcactttgggaggctgaggtgggcggatcacaaggtcaggacatcgagatcgtcctggccaacacagtcaaaccccatttctaccacaaaaaattagccaggcatgatggcgcgtgcctgtaatcccagctactcaggaggctgagccaggagaatcgcttgaacccaggaggcggaggctgcagtgagcggagatcgcgccattgcactcctgcctgggcggcagagtgaaactctgtcccagaaaaaaataaagcttagaaagaggctatgtagtctcgagataaatccagccctatgaggcacatgtcaatcacagagggaaagctatgcacgcacaaagcatgtgtgaatcagagagaaagctatgcacgcacgatgagtagaagacaaacacgtcctgcaaggagacggaggcgcagggaaggggcggcagccgtcctcccaagacatgaggacttctagttcagtctgagaccttggtgcagggctgggcgagtaaacaaatgcaaaagaataaggacctcgaggtcgggcgcggtggctcaagcctgtaatcccagcactttgggaggccgaggtgggcgcatcacgaggtcaggagattgagaccatcctggctaacacagtgaaaccccgtctctaccaaaaatacaaaaaacttagctggacgtggtggtgggtgccagtagtcccaactacacaggaggctgaggcacgaggatcacttgaacctgggagacggaggctttagtgagctgagattgcaccactacactccaacctggctgacagagcgagactgtctcaaaaaaaaacaaacaaacaggtctggtgtacccagaatggaggcaccacgagttgctgaagaaggaaactttattcagtctatgataccaggacagttgtccatgctgccaggcaaaaagaaaaactggattctgatctcattatcagtacacaaacagcgacaattagtaacactgacacagccctgactgtgctgctggagggtccgaagcactctctgcacagcggtgaatccccacaatagccctctagggaaggtgctgttatcacccacgcgagacacacgaaggaaaggcacggctttgcagcagcagggtcacgattcgaacccaggtggcctgctcttatgataaacttaaatgtgtaaaactttatgctcaggaaaatataagagaatgtcttcctgaccctttttggggtaggacaataatttctctaaccaaaccccaaaagcatgacccattaaaaaaagggtcaggtggactaacttggctaaatgaagaattctgtttcaccaaagtacaccacaaagtgggccgggcgcagtggctcatgcctgtaatcctagcactttgggaggccaaggtgggcggatcacttgaggtcgggagctcgagaccagcctgaccaacatggtgaaaccctgtttctactaaaaatacaaaaattaaccaggtgtggtggtatgcacctgtaatcccagctactcgggagggtgaggcaggagaattgcttgaacccaggacggggaggttgcagtgagcccagactgcgccgctgcactccagcctgggcaacagggtgagaccctgtctcaaaaaaaaaaaaaaaaggccagacttggctcacgcctgtaatcccagcactttgggaggctgaggtgggtggatcacctgaggttgggagttccagatcagtctgaccaacatggagaaaccccatctctactaaaaatacaaagttggccggcatggtggcacatgcctttaaccccagctgctcaggaggctgaggcaggagaatcacttgaacacgggaggcagaggttgtgatgagccaagatcgcgccattgcacaacagcctgggcaataagaacaaaactctgtctcaaaaaaaaaaaaaagaaacaaaaaaaaatatatatatatatatacataccataaagtgaaatcaacagccacaacctgggaaaaaatacttgcaacatggcaaaggattaatatccagaaagtataaagaattcctacaaaccaagtagaaaaacaggcaaaaaaaaaaaaatgttggcggggcatggtggctcatgcttgtaatcccagcactttgggaggccaaggcgggcagatcacctgaggtcaggagttcgagaccagcctggccaacatgatgaaactccgtctctaccaaaaatacaaaaattagccaggcgtggtggcaggcgcctgtaatcccagccacgcaggaggctgaggcagcagaatcacttgaacctgggaggcggaggttgcagtgagctgagactgcgcctgctccagcctgggtgacacagcaagactccgtctcaaaaagtaaagaaaaaaaaaaaacaaaacaacatatttcacagagaagaatttatgtttttggagaaggagtttcgctcctgtcgcccaggctggagtgcagtggtgagatatcagctcactgcaacctcaacctcccaggttcaagcgattcacagaggacaatttctaaaaggcaaataagaagcaggaagggtgcatgctccttctctactgccctgtaacagtcattccacacttaccacctcaaaacaacaaatgcttttgatgttggctcctgtggggcagcaatctgcgggaagcttagccaggcacctctggcttaaggtccctcctgaagctgcagtcacaccatggaccagggctgtgacctcatccgaaggctcaactggggctgaggcccacctctgagctcactcaggtggacgctggctgggttcagttccttgctggctataggtggaaagggcccccaccagtttcttgccagcttctccacaggacgccccacagcctgacaggagctttcatccagcaagctcatcagggagtgggagagagcagccaggacaggagcccagacctttctgaacctcatctcagaagtgacatccttcccttctgctgtctgggcacagctccccgggtggagcccgaggactagaaggaaaagaaaacttggatttaaaatgggataaagccataggagctgctcgtcccaccacaggaatctcaacgccgggttactgacaaagcgtcactttgcacctcgtccaactgtgcagacctctcctagccaggcccctgcaccagaggttaagaatccgtgcccctggtcaggaagtccaggtgggttcaaacggccagcagggaatttcaggcaaaatgtgtcccaaatcttcaaaccatgccccagaactcagacctccccctgggagttcgtcccaaggaaaccacctgcaagaggctcaggctgcaggggacactccgcttccaaaacccggaagctggagaccacacaagtgcccaacgccaaaggcaccccgtggagggacgccctgtgccctcccccgaccaggtgacccgctgcgccctacacatcttcaccaggaaacatctgttatcgatgtggacgaagcgcagcctgcactcccagatccgctcattttcgttctgccctccgttttacgattcgcctacactgaaaatgcgtgagtggagtggaaagccttcctactcctgcctcagcgaccccttctaaaatactgcctcgtttggcctgaaaatgtgatttgcaggcttcctgagcaaagtagatttcactccattaaagaaaaaaaaaaagaaaaggcaccgaacggggctcggctgtcgggagttttgctttagttttttgcgtgttttgttttgtgtttttttgttgttgttgttctttttgcggccacgcacaccgcgttcccaggcttcagggcgtgggggtcgccgtggactcccggacgtgaaaacgcttaaagccagctgggaaaaccccaccagcgttttccgcgcacagcgccagccataggaaaggacccccaggagcgaatccgggcagggaaaccccggacgcccgcacactcagcatcagtaccggcacccagcacccagcaccgagcaccgagcacgcagcacccagcaccgatcaccgagcagagcaccccgcacgcagaacccaccgagagcctgatgcagtctccgccgcaggcatagcgctaggccccggcgccttcacaacaaagggacgctggcgggcggggcctgagaggcgcgcggtggaggggccgggcgcgaggccgcggagacagctcggagctcggcactggggagtggcacagcgctggcggatccaggtgggcttcacggggcgcccgcgggaccggaaatgacgcgcagaaccctgcatcgggctcctcgctgccccgcgggcgccgctcctcagtgccccagagccacggagccggggaaacgcgccgcggcccacaacgcccccgcggctgcccgttggttccgcccgggccgttctactccaggcagacgggaggagaaacacggcgcgctcagcgtcccctcccccgttggttctgctcgggcccttccactgcaggccgacgggggtggaaacacgcagttttttttttttttttaaggtctagggtaacacggggcttttaagtgcctctccgctgccgcctggtggtccagcccgggccgttgcagtgcagccacacggggagggacacggcgcgccgagtgctccgggcggccgcacgttggttccgcccgggccgttccactgcaggcagagggagaggacgacggtgcgcgtagtgcatccccgtggcccgttggttccgccggggccgttccactgaaggcagaaggggggggaccgtggccccaccccccgcggcagcccgttggttccgcccgggcggttccgcccgggctgttccaccagcggcacttcagggcgggatcggccagtctgtggaggcagcggcctctaagccccggagggtttactgcccaggtttgggttccaggaataagaaatccactgaataggcttaacttagaagacacaaaggcgcctcctggcggaagtggccacgctccgcccagcctgagggaaagctgctctgacagctgggcccggagctgcggggggcggggccgccgcgcggggtgaggactcgcctcagggcgctgattggctggtggcgcgctccggggcggggccttcgtatccaggctggcgtcggggctgccgcgggacatccggagcagacacccgcgggcgcgcctgcggccccgaggacccccggctccggagcttcgtcgagcgttttcctagcgttactttcccaaataattttcaggaatgaagttacggctaaagggctctttagagattacttttgggccgggcccggtggctcacgcctgtaatctcaacactttgggaggccgaggccggcgcatcacgaggtcaggagcttgagaccagcctggtatggccaacgtggtaaaacgtcgtctctactaaaaatacaaaaattggccgggcgtggtggcgggcgcctgtaatcccagctactccggaggctgaggaaggaggatcacctgaacccgggaggcggaggttgcagtgagccgagatggcgccactgcactccagcctggcgacagagcgagactccctgtcaaaagaaaaaagaaaagattacttttggccgggcgaggtggctcacgtctgtaatcccagcattttgagaggctgaggcgggcggatcgcctgaggtcaggagttcgagaccagcctggccaacatagtgaacccccccccatctctactaaaaatacaaaaaaaaattacccgggtctcgtggcgcgtgcctgtggtccccgctactcgggaggttgaggcaggagaatcgcttgaaccttggagttgaaggttgcagtgaggcgagatagcgccgctgctctccgacctgggcgacagtgggagacttcatctcataaataaataaataaataaatattacttttacgttttgttaaacttccacttgtttttgtttccgttgcatgaaccttcgtaaagcttcaggaggctgatggcagcctccttccccaggcttccccgtggcgcccgcagccgggttgggccagaggctgggactgtttcctcccgtggggtctttggtggggatgtccccagaggagtggggcaggaggaggggcacggagcgcccccgggagccggtcagagcgcagcgatggtgtctgtggttccaaccactcgggaggctgaggtgggaggatggcttgagcctgggagcttgaggctgcagtgagctagaatcacagcaccacactccagcctgggcgacagagtgagacccttgtctcacaaaaaaaaaaaaaaaaaaaaaaaaaaaaaaaaaaaggctgggtgcgttggctcgcgcctgtaatcccagcactttgggtggccgaggcgggcggatcacgaggtcaggagatcgagaccatcctggctaacacgatgaaaccccgtctctacaaaaaatacgaaaaaaaattagccgggcatggtggcacgtgcctgtaatcccagctacttgggaggctgaggcaggagaatcacttgaactcaggaggcagagcttgcagtgagccaagattgggccactgcactccagcctggcgacagagtgagactccgtcaaaaaaaaaaaaaaaaaaaaaaggaagaaagaaaattataaaatgaagtgaaattaacgcagtggagtgccacctgcctgctgcctgagttcactatccacacggagttcataaatttgagagcagtttacaaagtagattctcctactttccaggaaacccagaaatgtctggtgatttgcccaacagtctcagctgttgtggtcagcagggccgctgtggtatccaaatgatttcaaaagcagatttataaaaagtactccttttttttttgagatggaatttcgctctcatcgcccaggttggagtgcagtggcacgatctcagctcactgcaacctccgcctcccgggttcaagtgattctcctgcctcagcctcctgagtagctgggattacagatgtgtgccctcacgcccagctaatttttatatttttagtagagacagggtttcaccatgttggccaagatgttctccatctcctgaccttgtgatctgcccgcttcagcctcccaaagtgctgggattacaggcgtgagctaccccacgcccggcctttatttttttttgagacggagtctcactctgtcgcccaggctggagtgcagtggcgcgatctcggctcactgcaagctccacctcccaggttcaagagattcttctgcctcagcctcccgaggagttgggatcacaggcacccgccaccatgcccagctaattgttttgtatttttagtagagacggggtttcaccgttgttagccaggatgctcttgaactcctgacctcatgatccacccaccttggcctcccaaagtgctgggattacaggtgtgagccaccacgcctggcctctcaaagtttttatagcaaagccttacatttcatgaggaaccatgcattttattttatttttgagatgggggatctcgctactttgcccaggctgggctcaaactcagggctctctggcctcagcctcccgagtagctgggtctgcaggtggctgtcaccgtgctgggcctggggtgtgcgtattaatgattttggaatagtgtctggaagcctgtgtgctttcctctcttcctctccccagaaggacctcccacctcgtcctcccaaagtgttgggattacaggtgtgagccaccatgtcccctctctttgctattttgcctgggaggagtgtattaataattttaattttaaagttctttgattatgttctagtttgattattgatcatttacttcttagctatttatattcttccttgagtcatcggtttctgccctttgacaatttttctgtgaatgttttgtgtcgattatatgagctttgtctgtattgagaacatccacgaattgtattattgcatctgttttgctagttgagaacatcgacctgctgtattattgcaaatgttttcctgcttgcatgtagtcatttgttgtgcatattaatgaatttctatccacatgacgccggaaggggatagagtgggtggggaggaagagggaagggtccccacctggagacccagcctgcaggccactcggccacctgcgcagaggtaggggagcagcagccgctcatgcccctgcaatttgtcctcatcagcaggtggggaaactgaggccggggagttctccaggccaaggtcactcacgggcaagttcccgcagcctttggaccctccatacatgtcagggccgctcatgctttcctgggcccttcactggtttggaggaaccatcctgtttcccagagcgcactgcctgtctctgagtgtatgtgtctcagtggcgtccatgtgtatttttctgtgtgtgtatctgtgtgagtctgtgtgtgtggtgtgtttgtgtctgagtgtgtggtgttagcgtgtgtctcagtggcgtccatgcatatttttctgtgtgatgtgtctgtgtgtgtgtctctgagtgtgtggtgcctgcgtgtgtctcagtggtgtccatgcatatttttctgtgtggtgtgtctgtttgtgtgtgtgtgaatctacgtgggtgtttgtccatctttttgtctggcctcctgtcccctctgcacagagcagctgggtggggatgctggtcctgggggcttgtcagcaggatgtgggcgtggggcagccctgggtgaggcctgagtacaggccccaggtgcctcctgcacaggggtggctgagccggctcctctgtggctcccgggtccccaccgccggtcactgggcaccacctgtcctggccacccactcctgcccaccctgctctccgcaggggcctccttcctctttcagctgtgcgccctggttgtggaggctcctaaggaggttgtggcctcggtttaccacctgccttggctccttggtgttgccagaccctgaaggcagcccatgccctggctgagatccttctggggcaggatgtgctggaagcagctgaaacatgtggtgatgtaccagctcctgctgtcccctacatccccagcaccgccagccttccctgggctcctccagctggcttctctaccctgtacctgccccaccctgctttcccccgaccctactaccccccaaccagacttccagctccaggcagggtcgcagcctcctgggctcccagcaggacaggcctcacccagaccccgcaggagccgtgggacttgggctgggtctttgggcctggctgcagcccctttggacctgacctgaggagacaccctggctgtgggaggcagggtgggggtgccgggcccagcacagaggtgcccagggtgcaggctggcactggcccggcagggaccgtggatgccgccgtttcaggctcgaaaaggtttccatgccccagagcctgagcccggcagcccccgaggatgtcttggggcctctgtgctccccaaagccaagaaggttaggcttgacccacagcctcttccaggccggggaggcagaggcgctccaggtcggtagggcggggcccacagcccagggtttcacgtccccaaaacggggcagggtgctggaggggcaggtgtccacagggtggtcgttttggtctctcctggacttgcacgcgtgtagtgcagactggctgccggcaaagccctgagccacattcatctgggccttgttaggacaacagggacggtgcggggtgggggggttgcggggcgcaggaccacgtcagtggagggagggaggccgatatcggtgcccaggctgggcccaggggccagcgggtcctcacctggcttgtggctgcccctgttaggcagcccggatggaggggctcttccagccctgctggccccgggaatgcagggactcaactccccctggtctcagtggctcttccgggagcaacacagcctgcccgagtcgacaccacccctcgggtttgagtcccttctgtctacccctacccccgccagggcactgcccccttgcccggaagaggcagcggcacccccagccccttggggaggatgccctgccggccccacactcggtggatgggcattttggggctaggatttaatgggggtgaccctgcccgacccctctatgttggttccacggcgtcagaagaaagctgttattaacccagcttattttctacaagtcttgtttattgaaaggatctgaaaagcgtaataaggctttcaatgacatttaatacattttcaagaaattaatatgaaacattaaaatttacttcaaaaatccaaagttttctagatcattcccatctcacgctgctttagaggtcagttcacaccttctgtgttcagatgagcggctggaattctgaacactgccgtcttccagccctaacgctgggcgctggtccctctctcctaagcccacggctgggcttcccctgtgcccagggtcatggcggacttcaagccaggccggctgcccagaatcacactcagggtttttggacgctcaagtccacagatgctgaggtgcccagacgagggtgagcagggagacacatgcctcggagaacgtgcccaggctgggccaggcggctgcgggaagctcctcacgggcagaggagaacgtcttgtgccttccttatcgatctccagcagatgagggcaactttgtgtgcaaaactcagagagcagttactcaaaaaaaagacacccgggcagcagtaaccaggacaccagggtccgaccacggcctccacacacctgtgcccgtggaagacgcgggcgccggggtaggcagcatccacgtgctccacagctgctggtgctgggcaggctggagactcacgggagaggcaggaggagaatcagcgtgttgagtccctcgctgtgttagtgtgaaaaattctcattacagttgcaaataaaagggatcacgatcactagccccggaaaccctcatctcccggaccatcaggatcgcactgaacagaatggtcccctaatggtccctgaggacagcgtcttgcagaacataaatgtaaacattgaatggcagacgactcccttccccttgaaatcttcacaaaagtgtgtacgagaaagtatgtacatcagcacttcagaaaaggggcccacaggacgtgtgcggggtgtgcagggtgtgcggggtgtgcggggtgtttgagggtccggatgtgcgtcccgaggtcggagggttggacgcccctgtgtccagttgttgggaggggtgggaggcctcgccctgctgttcagccccttcccctccactgggccgcgttcccagggacgtgcaacagggcgctcaggttaggagacccgaaaccacaggcagacaggacccgccacgcccgctcccagccctgggcacccccacccccgtttccttccagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggtgcgccctggctgggccccgggggagggggcgcggccggcgcccgctgagctcactctccctgcaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacggtgatgcccacggggccgggacagggctgcgtgggagctgggccttggccatggtcggggctgagggggcactgacggggctctttcccccacccggagcagaattccccttccccacggtggccaccaccccaccgccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcgggggggggctgtgcctgcaggagacgccccgcccccctgcagctggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgatggctcctcgctcattcttgggagggcagcgggcagccagtctgggcaggtggacaccccagcccctggtccaccgagagctgggcgtcctcggggctgggcacccctgcttccccgcacagcggaccacaggtacagcacaggacgggacgggctttgctaaggtggcccctgggaaagtgggataagaggaggccccagtgacaggggcagcacgtggagcagcacctggggtagccccagaagcctgggttctgtctaggacttgctcagagctgggggagggaggcaaagggggcttcctgaaagatgtggctgggatgggcctccaggatcttctgcaaggagatgtgggtgggggctgggaggactggcacagggtgggggaccaccttgccagagtggaggccccccaggaggtaggagctcccctcctgcctggggaagacactggcccacatggggtcagaggccacagccgcccaccccaccctcttcccctagagcccggtggtctgcgactcccctcccacacatggtcccgggtcactcaaaggacgacacggggagctttcctcgaagaatattttaatacattttaaaactcaacaaccttgtataaaaacctgtcgagtctgctggcacagctggggctgggggttgggggccgggggcctgtgtggacagggctggtctggacgagtgggttggggcaagagggcatcgctcatcccaacacagaaacaggtctccagctccgaagattaaacaatccacccggctcccaccagttcctttccaaatcacggcccagccagccccgtgcgtgtcgagagtgggagagggtgtgtggaggtttgtgctgccccacgtgggcacccgaagatgccctggcaagtcacggagaaaacacagctctttcctccacaacaaggaaaatgatttaattctacaaatttacaaaccaaaatacaaaaacaaaacatggagcacaaagtaagacgaggagttccgagtctcatcgcagctccagccgcagtagccacgcctgtggtcccggctgagttctccccatgacggggtccactctgaccttcagaacttgaggctgaagccggggcccgcggcagaggccccctggttcgtggtggtaaggtggaagcccgtctccttcaggtcgtcgtcaccctgggacgagtcggctaccgtgagaaccctgcccaagccagccccacctgtgggcacgccccacccgccaggcccctcaccagctggctgtagcccaggcctccctcagggggcctcgggctggtgccccgcttcacacgctgctgctcgctcttggcgggccacgtggggaacatggaggggtcgatggggaggggggtctcgcggaaatactcatgcttgaggccgtcctcagcgctgatcctcctcccggggaagtaggtcaggaacctggggggagagggccagaggcccaggaggtgctcgtgtgctccactgggtcccccaaagatgggctgtgttgggacggggctcagggcatgggacgccaggcaccagagcagttctggaacgtggtgagccagcaggtaggcctgggactgggaagtcaccgctatggctcgggacctcccgccacccggctgcactgggctcacttgttcatgaggtcgaagccctggtctgagagcagagccccgaagcgcttgcggaggttgttgtaggggtgctcgctgaaggtcatctttttgactactgggagctcactgtagccgggccagattttctcactgggggtccccagctcctgaaagacagaggtgcttcaacagccacaccaagtggcccacagtgttggcacctgtgtcccgtcagagaagacaagccaccaggagggctctcagtggccctggtccccatctcaacccagcacctgtgcgccccgcagccccattcctgcaactcctctgaaatccatagcgcacctgcggcagggccagacccaccttgaacactttgttgatctgatcgatttccgaattcccggggaacagaggcttctgagtcagcagctccccgaagatgcagcccactgaccacatgtccacggccgtggagtattcctaagacgccaggagaggtgttcaggaaggccagtgcccgcgaagctgtgggaggctgcatgggggacaggggaggcactcagacgcccaggactcaccttggcaccaagcagcagctctggggcgcggtaccactgggtcaccacgaccggggtgtaggccttcagaggggatccgtactcccgcgccagcccaaaatcacccacctgcaacgacagatgggcggctgtgggtgggcctgggcgggtcaccctgggatgggccactcggaggggggctcaccttgaggatgccggcgtggctcagcagcaggttggacgtcttgaggtcacggtgcaggatccagttgtcgtgcaggtgtttcaccccccgcagcagctggatcatcagggtcttcacctcccctgggagggagggaggctcccatgtggacccggccgccccaagcccagggcactcagggtggcccgctcgcctcggcagcaacagaggcttctcagggctttccctgtggatgcagctggccctccctgcagcactgtcaccgcgggggtgaccaggacactgcccccacttgtacgcagacaggaccccggggcgcggctgtacctggcaggaagggctgtttcatggtctccatcaggctcttgaggtcgtgctccacgtagttcatcacgatgtagatcttgtccatgttgctgcccaccacaatctcctgcagggcacggctctgtgggtgctgggcacctccaggcccccacccacccctgcacccgggcgcagatgctgagggacagtaaggacctccggtgccacccgggaggcaaatacttgcttctgtgtggtctgtgaagggctccactaagtgcaggagagtgtaggaagcacccggccccaggacagcacggggccctgtcggaaaagccttccacccggggccaggcgtggtggggccatgctcactctaacggtgacaatgttgggatgctgggccttgaggatggtgttgatctccctcagggacgtgatcgggaagccctccttctccttctccatcttcagccgctttagagccacaatttcatctgtgaagaaaatacagacggcactgagaggcattctcaaagtcacggtaccaacagtggactcgttcagtgaggaccgcaggcagtgcccaaagcgccagcatttcacggaggggggtctcgttctaggtgggggcacgtgggcaccaggagaacgccccagctgaggtctcggcaacacccacggcttcccactcaacacaccacagacactcacagccacctacagccacctgggatcccagcggccacgccgactccacatcgacttccccaacagagccggcctcacctgggatcccagtggccgactcccaacagagttcccggctcacacacctgcttgggtgggacgctgggaacgcaaacctgcacaccagccccggcacagaccactccacgcgctgggcctcggccctgtggggcaggccgcctgctactgcaagggagtggcaaagccccagggccaggctgacctctggcttctagaggtgctgaggggtccaacctccagtagctgctcaggtgaagcgggcccaggtgcagtcgcagctctcgggcagccagcccctgccccacttcccctgcctttgtggggtgaggggaccccacccacctgttttcttgtcttttgctctgtagaccactccataggtgccctcctcgatcctgttcaggcactggaactcctcgacgctccggcagccctgggaaggaagcgcctgtgtgaggtctcagtggccatgccagctggagggagggcggctgcgtccacaggcacggcacacccagcacggggcaggtgcagggcagagccttgggactgggccgggggtggagctgggagcagctcagttctttcaaagtctctttccttgcaaaaccatctgacactttattatgaaacaaaaccagtgtgaacaaaaggccatcccagccaggtgcaagggctcaggcctgtaattccagcactttgggagggcaaggcaggaggattgcttgagcccaggagttcaagaccagcctggccaacatagcaacactctgttttctttttttctttttgagatggagtctcgctctgtcacccaggctggagtgcaatggtgagatctcggctcactgcaacctccacctcctgggttcaggcgattctcctgcctcagcctccctagtagctgggagtataggtacgcaccaccacgccaggctaatttttgtatttttagtagagacaggatttcaccatattggccaggctggtctcgaactcctgacctctgatccgcccaccgcctcggcctcccaaagtgctgggattacaggcgtgagccactgtgcctggccaaaactcttctctacaaaataaaaaaattagccaggcatggtggcttgcgcctgtagttccagctactcaggaggctgagatgggaggattgtttgagcctgggaggtggaggctccagtgagctatgattaagccactccactccagcctggatgacagagacagacccagtctccaaaaaaaaggccatccggagagtctctctgtcaaagtggatgtgtcccctgcttgtaccaggatgacactgaggacgggccctacctgccaggcgcagcatgatgccccatgccagggcacctacccctcggtgtaccttggggccggtgcccaggccggatgtcacgtactctgggtggcctgtggcccgacgcctacgctcagcagcactaaggggcagaggcgctcacaaggcatagggcagtcgacagaggcctgctgcatgcgccagagagaacctctccgcccacaggcaccaaggagggggccgagtccctgccggtctcccaggcccccgaggccactggtaccttctcaggcttgtcccttccaaatcactcccaacaatatcctgccttattgatagctgcctgagcaaaaggcttctggtcacacatctacactgactcccgtagccgctcccccatccaagccctgcacagatgccggtaacaaggccttggtgcctacataacccgcccacgcaggggtcaagtggaaggcactgctctccagtgcggaggaggacgcaactcgggcagcagtgacagcagcgcggccgcacgcccaggctgcctttcaagccgcagagcagtcctgcgggcagctccctgtccacccagttccgtccagcatgagaaagaggcgggacctagaagcatgaggggccagtggctgtgcccgcccgtcactgccccagtgggcccagcagccctgtgaggcgacagacgccaacacgggggccaggcttcgctcagcccctgtggtaactccgactgccaatgcggacagcggcccggggcgaggggagggcctgacctgcagggccggcaggtacttgggcagctcctgcttgagctcgatgggcaacagggcaggggagtcgggcacatagtcgccctctgtcagggcgctgctctgcggcgttccctcacccacttcttcctctgcttcttcactctccccggaatctcggtcgaaccgtgactctggaactggaaaagttgaacctaattacgaagctaggagtaagtaaggatcatgaacctcctcctgccccgggggcatcaagcgcgtggcagggctgccccgtgtcccgctgggaggtgctggcgctgggctctcgtcccctggacacagggcaccgaggcctaagagtgctggcaggctcggctgagacagagcccggatgctgagctgggaggaggcgtcgggtgtcatgtgggggacaagcccacatccacgtccaccaggctgaggacataacctcactgcctgtcggaggctgggccaggcctctgttctgcagggacaggcccggagccaccatctgacgggcctcccctgtggggaactggtcctgggcttcccagctcctcggccctgctgggcactcaggacgcccttggtcagcactgtgcctcgctgaggaatgcgggccccaccggcacagcctggagcggccaacgaatcaggcggcctcccagaccctggcgtgccccacgccgcgcaggaccggctgtcttaggagagggctgctgcactcggagacagacaaggagggggctctgtctccagggaggttcttaccaaccaagaggtggttttcattttctcgttcttcatcttcactcatttcttcctcacttacttcttctgcaagagaaaggaggcgtctgctcagaccagcaccggggcgagtgctgccacaggcaggatgcgggctccgcttcagctaagcaacaagtgttcccaagaatggatatggaggctgggcgcggtggctcacgcctgtaatcccagtgctttgggaggccgaggcgggtggatcacctgaggtcaggagttcgagaccatcctggccaacgtggtgaaaccccgtctcgactaaaaatacaaaaattatccgggcgtggtggcgcacacctgtactcccagctacttgggaggctgaggcgggaggatcacttgaacccgggaggcagaggttgcagtgagccgagatcatgccactgcactccagcctgggcaacagatcaagattccatctcaaaaaaacaaacaaaaagaatcgatgtggaggtgtcccgagagagtcctagatagaagggagtttcaactcccccgcccgccagctacttctctgcggtttctaacactatagtgaagtcacaacacctcacacagtcgtcgcggtgcctcaccggcagactgctctgatgcctcctcagagttgctgccggtctcctcctcctcctcttcctcttcctcctcctcctcctctgattcttcactggtgctcccttcctcctcctcctcttcctcctcctcctcttcttcctcagaacctgagcctgattccgctgtagaaagacagcagagcagagggtgaacctgggccttcctgggcagcagtggtcaaggccttggccaggcggttccaggtacctgacgaggactcggccgagctggtcttcctctcgctgtcgctgatgtcctgtaagtcggacagcaggtccctttcttccattttctcttcttttacttatgagataaaccataaaggtgaatttggggaaatgtttttaaacaaacaagctaccaccaccccaaaactagtgcctttcacgtaacgattaactttgcttggtcggaaaccagctcatccacagacgctggaagccacttctctaacggggccagtggcgaatgtcccagcggataaacacacgtcctgtgtcctggccgcacacagacactcacggtccctctcacgacacgagaggacttcagccagcacatctctcactttcttctgaagcggttacttagctgggctttaaatgaatcctacacacttatgccaaacatcccccagaaaagactcacactgtgctggcttctgcgcaggcgccggcctggcctcacctggcttccggccgtctcccaactcgaaccgctcccgcggcggccgaggcgggctgcgactccagtggctggctttcactttgtcgctgtagtcctctctcatcgttcggtgatgtgcagacactggcgcgcagggcagagagggagatggcactagcagcactgccttcctcaaaaggccccacccggcacagctgcctcgtctcccacacccgcacctggcagacacacccacagcgtgcacagggtgctgacagcatcggggtcagaggccagaggtctcccaggaagcccagggagaaaaagctccaacctggaggccgtgagcccgaggacccaggtggaccttctagactgatcttcactggtcaaaaaggaaggggcgggagaagattctggaaagatggagtaggaagcactgggaatcagtctccccaccgagacaacacttgcatcacaggatcaggcctgtgcaactactgaggtgctctggagtctactgaaggtttgcaacttcagggggaatcttggagagtaaactgtgattcattaatcaacgtcaccgcttcgcacattagtggctcccacctcactccccgctggcaggcagcagcctgcatgcagctcgccggacccaggtgggcagacggacacacacacccgaggtcagtgtgatgactgcgtgtcccaccccagaggcatgaagaggcagcagccacggccacccccaagctgaaggtacttccagggcatgagcaccacgtcccccgttgcccccttcatttctctctattccccctttaggaggcagacacttcaggacaagaacattaaaaacatctgtattgacgggaacgttaaaaagtggctgcacgtgaccaggaaaaggctcaggctcagaaaagacccgtgaagaccctgagtttccacaacaggccgaccccacagacacagcccagcacaaccaaaacaacaagtgcacacccttgagtggggaccaggaagaatcacatcatgagaatcaaatgtccatttttttgactaagaaaaacacaagagaaacaaagaaacaggacagtatgtcccattcagaggggaaaaaaagaagccaacagacacggttcctgaaaatcacctgacggtagatgtcccagacaaagattttagggaactgtcttaaaccttcagttcctcagagaacgaaaggaagatgtggagaaagtcaagaaaatgacgcgtgaacacgacggaaatatcaacagagacagaagatccaacaagaaaccagagagaaattccagagctaataagtacatgctcacaatagacactaaaaagtaaatattcacaacagaaactcacaggcagatgtgagcaggcagaagaaataatcggtgagcctgaagacaataaaatcacatcgtctgaggaaaagaaagcagaagagactgaagaaaagggagcagtgctgagcggcctcggggaccccaacagatctgtgggagcccaggagggaggagaggagcagagagggtatctgaagaattcctcaaaacccccacattggatgaaaaccgtaaatataaacattagagaggctcagtgaactccaggtagaatgaagtcaagaggcccacaggaaaacccattattaaacagttgaaagcctaaggcaaagagaatcttcaaagcatccaagggatcctcaattaggtcatcagattaaagcatccaagggatcctctataagatcatcagatttctcatcagaaactttggaggccagaagacaatgggctgaaatagtccaagtgaaaaggaaaaactgtcagctaggcatgagggttccttgagcccaggaattcaagaccagcctgggcaatacagggacaccttgtttctactgaaaaatgagccaggtgtggtggcacacgctacgcctgtaggtcccagctacgcgggaggctgaggtgggaagatcacttgtgcccaggagttcgaggttgcagtgagctatgatcgctccactgcactccagcctgggcaacagaagaagactctgtctcaaaacaacaacaacaaaattgtcaaccaagaaccacgtatccagcaaactttccttcaaagatgagggagaaatgaggatattctcagataaacaaaagcagagggagttcattactactagacctagacctgccttgaagaataagctccagggagttgtgtggggtgtaaggaaaggacgcgagacagaaaccggaagctgggtgaagaaataaagatctccattaaggtgaggacgtgggtgactataaaagctcgtactggccggccgcggtggctcacgcctgtaatcgcagcactgtgggaggccgaggtgggtggatcacgaggccaagagatcaagagactattctggctaacacggtgaaaccctgtctctactaaaaatataaaaaaatagctgaacatggtggcgggtgcctgtaatccctgctactccggaggctgaggcaggaggatcacttgaacccggggggcagagggtgcagtgagccgagatcgcgccaccgcactccagcctgggggacaagagcaaaactctgcctccaaaaaaaaaaaaaaaggcaggggcgaaaagcaagcaccggaaccaagcgcccgcctgtgacagcaagtgcccagcaccagggggcagcagacacgcgtcccgccgagcacagctgcccaccgcgccgcctaccttccctgcgggcctcccgctccttgcgccgctcctccgcccgccgctcgcgctccttctgctcccgctgctccttctgctgctcccgcatcttgcgctcccgctcccgcttcctttctaactgctccaagcggtccctgaagaggcacacgccatcattccccctaaacagaagcttgcttatcgcgtttttgtccacatttgtaagctggctttctacgtaattcaatccgtgaagtttttttttcatttttttattttattttctttgagacggagtcttcatctgtcccccaggctggagtgcggtggcgcgatctcggctcactgcaacctccgcctcccgggttcgagcgattctcctgcctcagcctcccgagtagctgggattacaggcgtgcgccctgtactcccagctaatttttgtatttttagtagagacgagggtttcaccatgttagccaggatggtctcaatctcctgacctcgtgatccgcctgcctccgcttttcaaagtgctgggtttacaggcccgagccaccgtgcccagctgccatttccaattctaattaataaatgatccatttctttccattcgatcggtgtttgcttcatggattttgggctctgtggttagatgcattcacatgtatcattgctgtatcttcctgctgtattggcctgtttctggctgtgaagtccttgctccttcttgtttctagctttttttttttttttgagacagggtcttggtttgtcacccaggctggagtgcagtggcgcaatctcggctcactgcaacctccatctcacgagttcaagtgattctcatacctgagcctcccgagtagctgggattacaggtgtgcaccaccacacccaggtgatttttgtatttttactagagacagggtttcaccatgttggccaggctggtttctaatatttcttaacatctgttttgtctggtatgagtacagccattcaagctctcctatgacagctgatgtttgtacgctgcgtcttttcctgttctctagcagacagcatacagttagatcttgtttttctatctgataatctgccctgtctgtttggggcacagagacctttcacatgtcatataattacacgtacagttggatttactttccttgctttgttgtgtcttttttattcttccctttttgattttaaattacatacgtttagcataccattttaatttatttgtactttttagaacactaagaaaacaactttcttagtggttgctctagggatcaccatatgcctcatgatactagctcaagtccagtacaatataaaactgttgtaacacagcttcattccctgtcttctttgtgcagtccatttatgccacataccacgacaacagtgtaattattttacacaatcgtagttccagtaaaacctaagatgtgaggagagatatttacaggatattgacgtcaacctacacttgctatctgcagtgcctgtccttccttcctgaggattcaagttaccgtctggtgtcatttctattcaacttgaaggtcttcctttagtatttcctttaaggcaggtttcgccaacaatgaatcccaccagtctctgcttctcagggaatgtcgttcgttccctttcacttgtgtagaacagttttgattcctggctgatggttcttctctctaagcagcttgagtatgccactccactgccttctggcctccattgtttctaagaagtcagtggctggcggtattgaagctcccctttcatgggatgggtcattcttctctgagccctttcaacattttctctttggcctttgccagtttgactatgatgtgactttgcatttattctagttcaaacttcctgtgctcttgaatgtgcatattttttaattaaaatttggaaagtttttaaccattattgtaacaaatatctttcctctctcctggaacccccattcgacgtgctttggtacagcagatgttgtaccacgggtttctgaggctctgtgcatttttcttgtttttttctctctgttcttcagaatggataatttctactgctccatccacaagttgtttccaagcctttactaaattcaacatctggacactcaagacagtttctactgatgatgttcttcctcagtacgggtcacactgtcatacttctttgtattttagataatacatttgtagcaattctggattctaagttttccctttcgttgttaccaccaaggcctgtctggttgtccgtgaaatccatctccctcatagctcatggccaccccgttccttcccacatgcctattttaattttcaaccttggcttcctaggggtcaccaccatggctgcacagcttagcaattagccagcactggaaaaaggctgggctcaaatacctcgagcacagtaaggcttccttggcccacggctgtgtgtggacagggagcacactgaacgttcaggcgtcattcgcatctgtggcggcttctattttctgctaggtcctttcacgcagctgcatcctcagggctggtcacaagtgggtggcggctcgagctctctccagtctctgctgcacgtctttggcgggatcacagctgctcccaaccacactgtacttcattctagcagacctcttggccttttcctccctccactgaggatgctggtgggcaaggccactgcccactgctctaaacggagtaaccccttccaaggcagcaaggaaactgcaggtcctgcagctgccctgtcccagtggaacctccgtgcttccaagtgcagagtggaagcagtaaagggagcagctctcaggccagaaggtcagattcttactgcttttacccacagctcagcagttttccaagcatcagtgcttctcagattatccttatcagtttcctttttgtcagagacaaggtctctctacgttgcccaggctggcgtcatgcggtcctctggccttagcctcccacgtagcatatgctaccacacccagttctggattggctgatctgaatcggccctacccagaagtctgcccccaacaatttttgttcattcactctcctgtctttaccttctgggaaatcaatatgacagcccaaatttcatctaccaacctccacttctatcccaagctctactctcgtgggacaagacacactcaatgtctggcacagggcgtggcatacatgaatgtttcacacactaacaggaactaggccaactgaaaccttgctcacccagcagcggtctcggaccttgacccctgggcctcagtgtctcccacacccttcggcatcaacaagaaccagcgccctctcatcatctttacatgctgtgtacccagccctggctgctggcaaacatcgctgcacacgcccttccgcttcagactcctctcttcctggagcagcttgcaagctttctgtggactcactctgaaggcggagatgggcctgctcgcacctggcctacagcctttttcctggttcacagaacagatctggggctacaccgatgttctttcttgggaatctggctcataaaggggaacgaatatacagactaatggccaggagtcctaggagtccagtgtcccgatttccagactgtttcaaggtttttgggatctcccttctcctttttttgagacagtctcactctgtcaaccaggctggagtgcagtagcatggtcatagcttactgcagccttgacctcccaggctcaagggatccaaccacctcagcctcgtaagtgctggaattctagcgtgagccactgcgcccggcgggacgtgcagatttctgatcccttcattgtcttccctcaatcaaatcacacccgttcttacttccagatgcagtgaaaactcactccctcaggacagttctcttggtcagcctcgtccagcgttcactgtgctgtttccatgtctaccacttctgcaacaaatgtgacttctattgccaaattcttcttcattgctgtgacaggacacactaccacggccctttcataaagtcctcaactgacccagcccactcacctttctctcctggaatgctcccttgccatttcccttctcttctgtctttcccattcccggcgagctttatcctgttcttctcgatgtcgtttccgacgttcgtgctctctttctttcactctagcatgcttccctaatgagaaataaagtgtcatgcaaagaaacctcacttcaaaaatttcacgaggccgggcacggtggcttacgcctgtaatcccagcactttgggaggccgaggcgggtggatcacctgaggtcaggagttcaaaaccagcctggccaacatggtgaaaccccgtctctactaaaaatacaaaaattagctgggcgtggtggcaggcacctgtaatcccaggtactaagggaggctgaggctgtagaatcacttgaacctgggaggtggaggttgcggtgagccgagatcgtgccactgcactccagcctgggcgaaaaagtgagactccatctcaaaaaaaaaaaaaaaaaaaaaaaaaaaaaaaaaaaaaatcacatgaaaatgaaattaaatcaagaacattaaatatttaaataatgatgttaagtaatcctaatctttttttttttttttttgaagagacagggtctcactatattggccaagctggtcttgaactcctgggctcaagtgatcctccatccttgtcctcccaaagtgctgggattacaggcctgggccactgcacccagtcgaataatcatgattttatgttaaataaaaaactttgaaaatagaaaactatctgcagtaagcgtctaattatgaagaaagaagaaaaaagaaaaacaattctgctatcacagaagagaattgtaatattcatcttttaaaaattttctatactgaataaactataattatcagttttataatacaaaaaccactcttcacaaagactacagaacaaagctttgctatcagtgggcttctccactgtgcaatgaagccacattaattaatcaagcgtatttataataatgagatttcaatcgggctccaggtccaattttcctaacacccgtaagaatctcctgatgttggtacgagatcaaactgctcaagcctaacccattctttggacttgagcaaatacccattttggggtgtgtttttctcctatacttgttgaattcaggtcattttaaatgtaaacaaactgctcccaaacaatataatgggggagagaaaaccccagaggaaaaatggactagccattctgaatggtctgtgacacacgcacgctttcagctagagtttgctctctctggttttcggtctgtgacacacgcatgctttcagctagagtttgctctctctggttttcggtctgtgacacacgcacactttcagctggagtatcctctctatagcccctctgaacggtctgtgacacacgcatgctttcagctagagtttgctctctctggttttcggtctgtgacacacgcacgctttcagctagagtatcctctctatagcccctctgaacggtctgtgacacacgcatgctttcagctagagtttgctctctctggttttcagtctgtgacacatgcatgctttcagctagagtattctctctatagcccttctgaatggtctgtgacacacgcatgctttcagctggagtttgctctgtctggttttcggtctgtgacacacgcatgcttttagctagtttgctctctatagcccttctgaatggtctgtgacacacgcacgctttcagctagagtttgctctttctggttttcggtctgtgacacacgcatgctttcagctagagtttgctctctctggttttcggtctgtgacacacgcatgctttcagctagggtattctctctatagcccttctgaatggtctgtgacacacgcatgctttcaggtggagtttgctctctctggttttcggtctgtgacacacgcatgctttcagctagagtattctctctatagcccctctgaacggtctgtgacacacgcatgctttcagctggagtttgctctctctggttttcggtctgtgacacacgcaggcttttagctagagtttgctctccatagcccttctgaatggtctgtgacacacgcacgctttcagctagagtttgctctctctggttttcggtctgtgatacacgcacgctttcagctagagtttgctctctctggttttcggtctgtgacacacgcacgctttcagctagagtattctctctatagccattctgaacggtctgtgacgcacgtatgctttcagctagagtattcttttttttttttttgagacggagtcttgctctgtcgcccaggctagagtgtgcagtggtgcgatagcggctcactgcaagctccgcctcccaggttcatgccattctcctgcctcagcctccagagcagctgggactacaggtgcccgccaccacgcccggctaattttttgtatttttagtagagactgggtttcaccgtgttagccaggatggtcttgatctcctgaccttgtgatccacccgcctcagcctcccaaagtgctgggattacaggcttgagccaccacgcccggccttcagctagagtattctctctatagcccttctgaatggtctgtgacacacgcatgctttcagctagagtttgctctctctatagcccttctgaatggcctgtgacacacgcatgctttcagctagtttgctctctctggttttcggtctgtgacgcacacatgctttcagctagagtttgctctctatagcccctctgaatggtctgtgacacatgcatgctttcagctattctctctatagcccttctgaacggtctgtgacaccattatgctttcagctacagtttgctttctctggtttttcagtggtgctctggggaaggcagaagagtaggaacaggaaagaaaccacacttgaacatgatgtcaaagaaagtaaatgcttctgtacccccttctgctgaatggctatgatgcctacatttttcttttctcttttcatcttttctgtgatgaactttttctttccgagacatttgctggggtggtttgatggccaaagaatcatcttcttctcctctgaaataaaacacaacagcactgcgtcatgcttgagaaagtgcggaaaagcatcaggctattatgaggttttttcaacccagaaaaatgcatgattcagataggaacgaagctgaaacatcatttaaaaaattacattaattctccaacttcaggcatctttttttttttttttttttagacggagtctcgctctgtcacccaggctggagtgtagacacgcgatctcggatcactgcaacctccacctttccgggttcacaccattctcctgcctcagcctccggagtagctgggactacaggcacccgccaccacacccagctaatttttgtatttttagtagagacggggtttcactgtgttagccaagatggtctcaatctcctaacctggtgatctgcctgcctcggcttcccaaagtgctgggattacaggcgtgagccaccgcgcccggcctaggagtcttaagattcagatgaaaaatgtaagaaatcaatgttttgtgcagatggaacgaaatgcctctcagaggacctgcagggggtgaggggcaggttcattagcttgactgtggtgacagtttcaggggcatgtaaaaatacatcacatcttatttatttaatttaattttatttatttatttattttatttgagattggagtcttgctctgtcgcccaggctggagggcagtggcgagactctcggctcactacaagctctacctcctgggttcatgccattctcctgcctcagccttccaagtaactgggactacaggcgcccaccaccacgcccggctaattttttttgtattttttagtagagacggagtttcactgtgttagccagggtggtctcgatctcctgaccttgtgatctgcccgcctcagcctcccaaagtgctgggattacaggtgtgagccgccacgcccggcctgtatttatttttttgagatggagtctcgctctgttgcccaggctggagtccagcggcgcaatcttggctcactgcaacctctgcctcctgtcccaggttcgagcaattctcctgcctcagcctccggagtagctgggagtacaggcgtgcgctaccacacccagctaatttttatatttttagtagagacggggtttcaccatattggtcaggctgatctgaaactcatgacctcatgatccacccgcctcagcctcccaaagtgctgggattacaggcatgagccatcgcacccggacttattatttttttcagacagaatcttgctatgtcccccagggtagaatacagaggcacaatcttggctcactgcaacctttgcctcccacattcaagcaattctcctgcctcagcctcctgagtagctgggactacaggtgtacaccaccatgccaggctaatttttgtatttgtagtagagacaggctttcaccagtaaccctaggaaagagtaaacctcaatagttgtaacagcatgccctgtcacagtaatcctaggtcgtggctcgcacctgtaacccagcattttgggaggccgaggtggacggatcaccaggtcagaagatcgagaccatcctggctaattttttgtatttttagtagagacggggtttcaccgtgttagccaggaggctgaggcaggagaatggtgtgaaccagggaggcggagcttgcagtgagccgagatggcgccactgcactccagcctgggtgagcaagactcttgagacaccgtctcaaaaaaaaaaagagtacacttcagtatttacaacagcacactgagcacactgtcacagtaaccctaggaaagagtaaaccttaatagttacaatagcacaccccgtcacgtaaccctagggaagagtaaacctcaatagttaaaacagcacaccccgtcacagtagccctaggaaagagtaaacctcaatagttacaacagcacaccctgtcacggtaaccttaggaaagagtaatctcagtagtacaacagctacaacacgccctgtcacggtaactctaggaaagagtaaaccttaatagttacaatagcacacagttgtcacagtgaccctaggaaggactggccaggccagggctgtgtacagttgggtcttgcacatctgtacatccgctcacctgtcttccattgagtcttctcttctatacggggagttccttattgtgatctccatgcagtgatctctcagctccccctcctcaagggaatcccgcttggaatcccggtcatcagactaagaagcaaagagaaagttaatcattttctttataagtttttttttcttcatagataaaagtatttttaatgataatcaaacctgggcaacatcccaaaacaaactttcacatgtactctgaatgagccagtgttataaaatataaagaatttttggccaggtgcagtggctcacgcttgttaatcccagcactttgggaggccgaggcgggtggatcacgaggtcaggacattaagaccatcctggctaacacggagagaccccatctctactaaaaatacaaaaaattagcttggcatgttggtgagcccctgtagtcccagctactcaggaagctgaggtaggagaatggtgtgaacctggccctgggcgacagtgcgagattccgtctcaaaaacaaaaaaaaagctaacaaagtgagcacatgctattggaaaaatactcaaagcagagttgctacaaacctttaatttggaaaaatttcaatatctgtgaagcataataaagtgaagtgcaaggtatgcctgtactcactaacatcccaaatgatgctacaaatcttagcaaaagaggtactttgccaatgcctcttaccaaattactaaaaaggtttcctgagtacattaccatgcaaaccaagaaagacgtaaaatatttatattaatttcaaggcaagttcccactatattaaaaatacttagagatagtattatgaatatactaataatgaaccgagaaaaattagtccagttttgctaatgacttaacattcaacgtattttattctccatgtatgctcaatctagacacagctttagtgtgttaaatctgcctttaatgtcaactgaatattagaatacattttgggctcacctgcgacatttggaagtacaaaagaacttcaccgaagaagcgttgttctaatggaaaaatgagggcaaagaaattaaatctcctttaagaaaaccacttacttaaaaaaatatggcttacattttttaagcgttttatctctgctttctcctcttgttccttccttcgtttcttttcctgaagaatttcatctaaagttttcactttccaagagtccttttcatcacccatttgagttaaaacactgcaaaaagaaaaataattcagcctacatcaggacacagcaagctatggtgctgaacacttgaacctagtcacttttgagggattcagaataaatcctcattaagaataagaagttgtgcccggcgcagtggctcaagacggtaaccctagcactttgggaggccgaggcgagcagatcgctggagttccggagttcaacaccagcccgggcaacatggcaaaacctcgtctctacaaaaaatacaaaagttagcccagtgtggtggcgcgtgcctgtattcctagctacaggaaggaggctgctagaggcaggaggatcacttgaatcagagaggtcaaggctgcaatgagccaagactgcgccactgcactccagcctagataacaaagtaagacttggttaaaaaaaaaaaaaaaaaaaggtaagctctaggctgaggcgggtggatcacaaggtcgggaggtcaagaccagcctggccaacacggcgaaaaccctgtctccactaaaaatacaaaacttagctgggcgtggtggcgggtgcctgtaatcccagctactcgggaggccgaggcagcagaatcgcttgaatccgaaaggcggaggttccggtgagccgaggtcgcgtcactgcactccagcaagaccccgtctcaaaaaaaaaaaaaaaaaaaaaaaaaaaaaaaaaaacaagaatgataagttgtaagccaggcaaggtggcgagcgcctgtagtcccatatactctgcaagctgagatgggagaccgattgagcccaggagttccaggctgaagtgcgcttgtgaacagccactgcgctgcagcatgggcgacaaaaaagagtgatgggttctgaaaaatgaccgcttgaaatcaagtctcgtttctgtcattcttgtatggtcttgggtaacgtaattcacctcagttcagtcttccgtacaaccagaataacaacacctacgtgatagtatcgatcgcggattaaagatcatccgtttaaaggctcttaactcaggacctgccactcatcaaacactgcttttactgtcagaatctgctagaaagaccgcttggactacgtgaagccactagcacactggacagctgcaccttgagaccggggagatgctccgagatgtgctcgcgaacaaggccacctgacccgggcactgggctatttcctcgggttcagtcccgcacacttgaggttcagcctggcagacgttggctccagacagcgtttggacccgccgcctccaccacccaaagttccgtgcgggatgagactgtccgcggaagcgagggtgtcgctcgcccccgggcccgggtccgccccgctccgaggcctgctcggaagaaagacctcggtgcgcagttctcgtcgcgctcccacacctggtccgcccagtcggaactcacccctacggggccgcggccggtccctgagcctgagaagaaacagcaaccggcgctcgccagaagtatcctcacttcctgtgttgacgcctaatgatgatataatagccgacctctggcccagaactcaagacgacaggggctcgctctgtgcggcacttcctgtgtctgcgcgggatgatgacgcataaaacagcgcttgctcaggtccaggactccaaaagaaactgcgccgtgagctgcacttccgacttcggcgcgggccggggcgccgagcagagcgacgccgacttttggagcagtttgcgcctgcgcggaacgcgtggccggcttccggaatcctaccgggacttttccggtagcgaagcccgcgcctgtgccaaggcttgcgagcagaatgccttcgcgatggacgcccgcattccacccccttgaccgctgggacccctagtggcgggtgggtggagcgcgctccatttacctgctggttacctcgtgaggcgcctcaggtctgtgtgtcttgtaaaggccgatctcggaatttaactctgaaccttactcagaaacaaagcagggagagctcttacgatgtgattttattttatttattcatgtatttacttttgagtcggagccttgctctgccgcccaggttggagtgcagtggcgtggtcttggctcactgcagcctcctcccgggttcaaggaattttcctgcctcagcctcccgagtagctggaaccacaggcccgcgccaccacgcccggctaatttttatatttttggtagagacgaggtttcgccatattggccaggctggtctcgaactcctgacctcaagtgatccgcctgcttcgtcctcctaaagtgctgggattacaggcgtgagccaccgcgccgggccttttacaatgtgattttgaagctgacactggcagtgggtcctcaaagtgcagactcactgggtatggtgcttcccccaactcccagggccccactccaaacccatggattcagagcattgcaggagaagaggataaaacgagcaattaattccctttccatatgtcaggttttcctcttgccttgaaaagtcacagaaaaatgctttagacatctgaatctcaggaaacaaacaatggaagataaacatccgcatttactgggcctgaaatgggaaaatgaaagatgtggcaagaaactgacaagggcccaagaagggcgatgggtatcggaattcttttcatcccggaatgaaatgctgcttgctttgtgtacccaagctctttttttatttttatttttttgagacggagtctcgctctgttgcccaggctggagtgcagtggcgcgatctcgggtcactggaagctccgccacccggattcacgccattctcccgcctccactccattcgcccgcattaggctcctgagtacctgtgactacaggcgcctgccaccatgcccggctaattttttttttattttcggtagagacggggttttaccgtgttagccaggatggtctcaatctcctgacctcgtgatcagcctgcctctgcctcccaaagtgctgggattacaggcgtgagccaccgcgcctggcctcccccaagctcttaatgttgcttcctgagttcttggtaactggggaaatctccctatttttttatttttatttttttttgagacggagtcttgctctgtcgcccaggctggagtgcagtggcgcaatctcggctcactgcaagccccacctcccgggttcaacgccattatcctgcgagcctcagcctgccgagtagctgggactacaggcacccgccaccgcgcctggctaattttttgtattttttttagtagagacggggtttcactgtgttcgccaggatggtctcgatctccttaccttgtgattcgcccgccttggcctcccagagtgctgggattacaggcgtgagccactgcgcctagctatttttattttttctgatagggagactcgctctggcccaggctggagggcagtggcgggatctccgctcattgcaagctccgcctcctgggttcacgccattctcccgcctccactccattctcccatcttaggctccagagtagctgggccaccatgcccggctaattttttgtatttttagttgagaccgggtttcactgtgttagccaggatggtcttgatctcgtgacctcgtgatctgcctgccttggcctcccaaagtgctgggattacaggcgtgagccacagcaccctgcccttttttttgagaaataagtctcactgtgtcacccaggctggagtagagtgacacaattttgggtaactgcagcttccacctcccaggttcaagtgattctcctgcctcagcctcccgagtagctgggactacaggcgcccaccactacgcccggctaatttttttgtgtttttagttgagacggggtttcactgtgttagccaggatggtcttgatctcatgaccttgtgatctgcctgccttggcctcccaaagggttgggattacaggcgtgagccacagcacctttttttttctgttttgagagaaagtctcgctgtgtcacccagactggagtgcagtggcacaattttgggtaactgcagcctccgtctcctgggtacaagtgattctcctgcctcagcctcccgagtagctgggattataggcgtgcgccaccacacctggctaacttttgtatttttagtagcgacagggttttgccatgttggccaggctggtcttgaactcctgacctaaagtatctgcccaccagcctcccaaagtgctggaattatagtcatgagccaccgtgcccggccaaaaatctccagtttacccttcctttgtgaaatctgttgagtacccaaatgcagccactcatgtcaaaccctaacaaaatcgaccccagagcccacgaggagggggtggcctcgcacttgcgcttgataggagctgccacaaaggcctttcccaaccagaactttgggtccagccacttctgtgaagagcctctttgctagcaatagccagccccaccggtgaacaaagtagcatgaacaccagaggtccacaaggaagaaaacaaagcagtccatatttaacatttattttactttgctgagcaagaatcatagacagctactaccacggctgcttcgtttggacaaaaataaccaggaggcatccacgggattagttacacggtatcaacttaccaccacagcagaatcaacagtgactcgctaattaacagaaccgtttgctagaaagcactaatctagttatataaatactgaaataggtcacatgcaaaacactataaacgttttgtgtgatgtacttttagttctccatagttttgtttggtataaaggaaatataatttggctgtgacgtagactgttgatgtaattttcaagttttcctgtatggggaaagttgccctgactgtggcccttttcaaggtggagcctccaacaccacgttggcagattcagactccgtgaacagtctaaatgagcaagtcagctgaatgccactttcagatggaagggaaatgagatggaaaacaacaaaaaaggactgccaggcggaacagtttccaaccgagttttcgttgagtgaggatccagcagccatcaaactcaaacataggggcccgcagggaaactggaggaaatacttcagagacagcaaagctgaaggtttctgtgctctgagggatccgagagtggatgtcccactcctgtatcctcagccagacacagaactagccagattcattagggaagctcagatgctctcattctataaagtaaggcccccagcagggcacgtacatacattgggaaagaagaaaccccttagtaccatgttggtcaaaggcaagagagagaattctatttccatctggaatgtcattcttgtttacttcttccaacagtgaaatacttccaggccttcgaaaggccatcctttggacacatgtaaaaagctgtcttgttggcccgttattcccactgacccgtctgagtgatcacccaggagcgcggcggcagcaagcagagctcaccggatttgggacaaggattttaaaggcagctacaaagctgagctctatttgctgatgatagtctctgttcagctgtttaaaatgactgtctgactcaccatggtaatttttcacaaattaaaaacacattttgggttgtgcaacagtgttctcatctttccaggcaggcagattattttaatgctgttatacagggaattgggactctcggattttcttttttaacctttttatgcctttcagtaggggaagtttccttgaaagttagagagctgcaaatctctaagtatcaatgtaaagaagccgatgacccaattcggaaggtggttcaagtgttctgtttgtttacaaaggcacagaccacgaccatggacacacccagtggaagtaaccacacccggtgtgttcctagaagctcatctgtgacagttcaacaagaacttactattctagaaaagtattacacaaagttatttaaaaaaatgtctgtacaatcgttaacacggccaagccaggccttgggttttgcctcttggtgtccagctgtgctgggaatgccatgaagaccagcggctggaaactgacttgggcatggagaagagactgagggagagggaggggacagcacgactgagcaagggcacagtgctggctgcctcatgggctccaggctccttctgccaggatgaggaagaggccccagagcagcgttacacaggaaatcaacctatttgctaatcctttggaaaaacgtttgtttctggtccacaaacagaaaatccaaacaggatggcagctccttgtgagggtggaggggagggcaccagattctgtgcggctggaaattccaaggtgctcagaaccaggcgcctgcacctctccttatgccagaccacaatcttcaaagaggccggcagccatattctcgatggggaggtggacaaggccaccctgggagttgctttcaatctgtcctcacaaatcaacaactccccgccacctccagagcattttctaatagtgtttgtttttgagacggaatcttgccctgttgcccaggctggagtgcaatggcacgatcttggctcactgcaacctccgcctctggggttcaaacaattctcctgcctcagcctcctgagtagctgagattacaggcacccaccatcacacccagctaatttttgtatttttggtagagacagggtttcatcatgttggccaggctggtctcgaactcctggccttgtgatccgccatctgcagcctcccaaagtgctgggattagaggcctgagctaccgcagccggtcttctattagtttttgaggaaagcagaaaaaaagaaatggaaacccagggaaagtcacgtgacaaaacatcttcgcagcgcagtgagcacacacctggcctgtcctccacacacaggtcagcggttttatagaagcggctgaagcaggtgtagtagcccacgcctatattctcgacactacaggaggctgagtgggaaggattgcttgagccgaggagttcaagaccagcctgggcaacaaagcgagagcccagctcaacaaaaaaatagccaggcatggtggcacgtgcctgtggttccagccacatgggaggctgaggtggatcacttgagcccaggaagtcgaggctgcagtgagccaagatcatgccactgtactccagcctgggtgacagacagagcaagactgtctcaaaaaaataaaaaggttacttgtgggttaaaaagcctcacttcggtccatcatcatggcagacttttttgagtaggtagaagttaatgagtcagaattattgctctgtttctgaacgattttatcttcaggaggggctatttttgtatttcccaggtgagaagccaaatggaaaaccagtgaagtgaccatgggtgccaaaggcctaaagagcaggcagggaaatgagactcgggaccactggagccccatgctgcctctgacaagccctggagctctgggtctcaaaggctggctggcaacaggctgcaccgggcatgggaatccgccggctgcgagattgggggtaaagagctcagacatggtcagaagcctctgcctaacacacggctccagtagccactcctcaggcctcctgcgccctcgggggtgcgtgacacaggaggatgagttgagctggctggtggccccagtgtgccgtactactgtcccttggggagagtgggacagggtgggcgcctgacacacaccacgcgccccagaaacattcagtgtggacgtttcctttttcagcaaggacggcgcccaggtaaacgccacgtaacccaaaccatcaacactgcagcgtcctgcccaaggctcacgtggggaaccggacaggtgctagatgatgataggaacggtgggctctgagggaggacagacaggctcaccccacggggacctcagaacagcctgcctcatactcagagtccaaaaaagaaaaggaacgtacacatctcctcccaagttaaacacgagaggtttgtcctcaacctcagggctggaaaccaccacaggtaggaggctgggcacgggggctcggcctgtcatcccagcactgtgggaggtcgggtgctagaatcccagcactgtgggaggccaggcacgggggctcacgcctgtaatcccagcactatgggaagctgggcgtgggggctcagcctgtaatcccagcactgtaggaggccgggcgccgtggcgcatgcctgtaatcccagcactgtggatggccgaggcaggcggatcacgaggttaggagttcgagaccatcctggctaacacggtgaaatcccatctctgttaaaaatacaaataactagctgggtgtggtggcgggtgcctgtaatcccagctacttggaaggctgaggcaggacaatagcttgaacgcgggaggaggaggctgcagtgagctgagatctcaccactcactgcactccagtttgggtgacagagcgagactctgtctcaaaaaaaaaaaaaaaaacaagaacatctcccacacactcacagtgcctttgtagccccagggaaagcaatcccttaagatcatttgttgggtgaaaagggtaccaagtacacagtgttaggaccgtgcaaaaaaagggtgacaggaagtaccctttgcaaactttccataatgtgtacttaattcactgctcttataaaatgaaattaaataaaacaaaaaaatactactgaaaaataattgggcaacatgcggtggctcacgcctgtaatcccagcactttgggaggccaaggcagacggatcacctgaggtcgggagttcgagaccagcctggccaagatgatgaaaccctgtctccactaaaaatacaaaaattagctgggcatggtggcaggcacctgtaatcccagcttctcgggagactgaggcaggaaaatgtcttgaacctgggaggtggggttgcagtgagccgagatcgcgccactgcactccagcctgggcaacagcgtgagactctggctccaaaaaaaaaaaaaaaaaaaggaaaaataattgggctgagtgtggtggctcataattgcagtcctagcgctttgggaggccaaggtgggtggatcacttgaggccaggagttcaagatcagcctggacaacacagcaaaatcccatctctcaaaaaaagtaaaataaaataaaataacaaaaaacaaaaattagcccagcgtggtggtggacacctgtagtcccagctactcaggaggctgaggcgagaggatcacttgagcagggaggcggaggttgcagtgagctgagatggcaccaccacactccagcctgggtcacagagcaagactctgtctcaaaaaaaaaaaaaaagttttttttttttgaaccactgctaacaatcactaatgttcactaaaacactaggcttcaggagcatttggaaataattcctgaccgcacaaagaaacatgctggtgagagacagtgaccaagcccaggagaccaccatgagttccagaaaaagtgagagagagcggccacttttcctgtctcggagatacctcctactcaggacgcaggaagcatggggcagggcagcgccatggacaaggcgactcggtgcagggcctgcgggacctgcaggtgagaggaagcacaagctccagctcctcagctgtggaacgctgcgtgcgtggtgcacagctaccagctcggatgggtatttgagaatttaccgcactgacttggaccagacggaaagcagagaagagggagagctacacctgactgtccaccattcccgccagccccaacgtcggcttttcacttcatgtttggggacaattacacctcctcatgacagatcagaagtttcagaaaaaaggtccgctgatttccgcaacagggtatgaggtggccagctgctgatgccagctgcatggactcctatacttgctggtaacataacctcattcctttgtatttgccaccaaaaagtctccagtctttttttttttttttttttttttgagacggagtctcactctgtagcccaagctggagtgcagtggcacaatctcggctcactgcaacacccgcctcccgggctgaagtgattctgatgcctcagcctcccacgcagctgggactacaggtgcatttcaccaggcctggctaattttttgtgttttagtaaagacagggttgcccatgttgcccagggtggtctcgaacccctgagatcaggcaatctgcctgccttgacctccagtccacctggctagtctccagtctttaaattgcacctttggccgggtgcagtggcttgcacctgtcatcccagcactgtgggaggccgaggcgggcggatcgcctgaggtcaggagtttgagaccagcctggccaacatggtgaaaccccgtctccactaaaaatacaaaaattagccgggcatggtggcacgcgcctgtaatcccagctacttgggaggctgaggcaggagaatcacttcaacccgggaggcggaggttgcagtgagccgagatcaaaccaaagaaatccagctctgggtgacagagcaagactctgtttcgggaaaaataaaatacataggcagggcgcggtggctcacgcctgtaatcccagcactttgggaggctgaggcgggcagatcacaaggtcaggagatcgagaccatcctggctaacacggtgaaacccagtctctactaaaaatacaaaaaaaaattagccgggcgtggtggcggacgcctgtagtcccagctactcgggaggcagaggcaggagaatggcgtgaacccaggagacggagcttgcagtgagctgagatggcgctactgcactccagcctgggcgacagagcaagactccatctcaaaaaataaaataaaatacataaacaaataaattgcagcttcattcaatctgcccagttacagaagtggaaagaagctgaaggatcctccccgtttctagagctgcaccgcatggcacaggaagcagtggccacaggtgtctgttcaagttcaaactgacagcaatcagcttgaattccgaatctggttcttgttatattctccacatttcaagggctcagaagccgtatgtggccagtggctcctgcactggacagcccagaagagaccattccattcctgcagacaaaactagtcgcagcaccctgctattctagacagaaagcactcaatttcaaaaaccttcaaactcagagacttctagtggagatttccctaaatacctatttcacacagtttacggtttattttacagtttctcatttgtttttttgttttatttattttttttgagaaggactctcgctcccatcccccaggctggagtgcagtggtgagatctcgactcactgtaacctctggctcctgggttcaagtgattctcctgcctcagcctcccgagtagctgggattacaggtgcccagcatcacacccggctaatttttgtatttttagtagagatggggtttcaccatgttggccaagctggtcttgaactactgacctcaagtgatccacttgccttgtcctctcaagtgctgggattacaggcatgagccactgggcccggcctatcgtttgcatttcaaacagcatgggtataaaatagcctagtaattacactgcatagccacagtcatccccgtggaagagaatcacatgtgtcccttataaaaatacctagatttctggtctcctttgtaaacaacctggacacactcaactcttgggaagttcctctgctcacctgaaagtcaccggggagattttccccatgagggcgtacgccgtgacgctctgaaggtggaacaggactccgtctgtcagaagcagcagcaccacgtcctggttgtagctgaagctcttcccgctcctcccgatcactgggacgtcctatgtggcaaacaaaagggtactctattggtttccattttccatttactaatcatccaccacgaacacccagcgccactcctgcccagaaactgggtaaagctgctgccactgaggacagccctgaaaatgcctcgaggggacagctgaactgtgcactcatccattttctgttttttgtttgtttttattattttttgcactaattaattttcaccatgcagatgcaaatggacaacaagcacatgaaaaaggctgaacatcaccatcatcaggaaaatgcaacagaaaccccaatgcggggccgggcgtggccagtctggccaacacggtaaaacctcgtctctactaaaaacataaaaactaaccaggcatggtggtgggcgcctgtaatcccagctactcaggaggctgaggcaggacaatcacttgaacccggaggcggaggttgcagtcagctgagatggcaccactgtaccccagcctgggcgacaagacagagacttctctgggctgccagaggctccggaagccgggtgcctcaggccgtggcagttccgtcactctccaacgcctcccccacagacttctttttgctaaatggtatcaagattttctcgttgttgtcagcaagagagttggttttctaacatctcatcgaccatggctggaggtcaaatcgatgttttaaacttgctggaaataaacggttcctttcttgcatggctcgatgagcaataaggttcctctgtgtcattttgtttacgatttttaggattgctttttaaagccggacacggcggctgatggctgtaatcccagcactttaggaggccgaggcaggaggatcacttgagataaggagttcaggaccagcatgggcaacacagcgagaccccatctctatagaaaacacaaaaatgaggctgggggtgctcatacacgcactgagggttgaccctggtgttcttgccttcttagattcttctggagctggagatgaactcggacctcaaggcccagctcagggaactgattattacagcagcgagggaaactgaagttggtggtggtgagaaagttatcatgggcaggtacagcagctcacgcctggaatcccagcactgtggggagctgaggcgggaagatcacgaggtcaggagctcaagaccagcgtggccaacatggtgaaaccccgtctctactaaaaatacaaaaattagctgggtgtggtggcacgtgcctgtaatcccagctactcagggggccgaagcaggagaatcgcttgaacccgggaggcagaggctgcagtgagccaagattgcgccactgcactccagcctgggcaacaaagcgagactccatctcaaaaaaaaagagggccggctgtggtggctaacacctgtaatcccagcactttgggaggctgaggcgggcggatcaacgaggtcaggagatcgagaccatcctggctaacacaatgaaacccagtctctactaaaaatacaaaaaattagccggatgtggtggtgggcgcctgtagtcccaactactcaggaggctgaagcaggagaatggcgagaacccgggagatggagcttgcagtgagccgagatcgcaccactgcactccagcccgggcgagagagcaagactccgtctcaaaaaaagaaaaaaagaaaaaggccaggcgcaatggctcacgtctgtaatcccagcacttagggaggccaaggcgggcagatcacttgaggtcaggagttcgagagcagcctggccaacagggtgaaaccctgtctctactaaaatacaacagaattagctgggtgtggtggcagacagctgtagtgccagctacttgggagtctgaggcaggagaatcgtttgcacctgggaggcagaggttgcagtgagccaatactgagccactgaactccagcctgggcgacaaggcgacactctgtctcaaaaaaaaaaaaaaaaaagaaagaaagaaagaaaaaaaaaaaaaaggaagttatcataatctttgttcttcttctgccactgaaataattccagaacatccaagtctggctagtacgtgaattggagaaaaagttcactggtaagtatgtcgtctattgcttagaggaaaattctgcctaaaccaactcaaaaaaggtgtacaaaaaataagcaaaagcgtcccaggatccacgctccgacagctgcgcacgtcgcaatcctcgaggactcggtcttcccaggtgaaattgtgggcaggagaatccgcgtgaaatggacacagcagctcacaagggttcattcggacaaagcccagcagaacaacgtggaacgcaaggtccaaactttttctggtatcgataagaagctcacagccaaggctgttaattctgaatccccagagttcccagtttcaattgttaagaaaaatgactaacgtatactcacagtgaaaaaacaaaaagacacacaaaatacaaaaattagctgggcatggtggcacatgcctgaggtcccagctacccaacaggctgaggtgggaggattgcctaagcctgggaggccgaggttgcagtgagtcgtgacctcgccactgcactgcagcctgggcgacagagcaagaccctgtctcaaaaacataaaaaaaacaaaagaaaaaaaacaaaaaaaaaccagagttgacttttaggctttgattttgttataatcacctaaacgtgtgtgcgggtctcaagtgcatgtggggcaagcccaaccccatcctggaccctcggcctcctcccgtccccaaaggcagacagacacttccctcggccttaagatcttgtcgtttcttaaataagcgaacacgtgtgcacccccacactccgttcaagatgccgcgctctgtgggcgcctctgctcctcgctggttttcatgcagccacactgggtacgcgacatggggctgacatgtcactggaaatcgcctgtgagtcattaagaggtgggagaggcaggagcctgggttgcagctgaggtcaggggctggggcccaggacaggcctgtggtggcgggtgctggggaggctgtggggtgctggcacaggagggcccacggaccaggggccacggccgcctgtatggtgctggccgaaggcggcccccgcccgtcctcttcggatcagtgattggcacctgcagtaatcttgcttgccaggaatctgcccagcccccacctgtctccccacccagttagggccacgagacacaaccctgccctgacctccgcatgccagtgtgagaacacctggcagacgccaggctccaagacacccccgcacatgtgaccgtgagagaagtgaaggcactgccagtgtgggcaccactctgagtggtcctcgcggcagagccccatggcaggcagcagagacgggcaccacggatggaggcctgggatggtggggcgcaggcggaggggtggggcccagggggcctcacctgtgtactcccccagaatcatccgagacatgatcaccgtgaagatgggggcggagctcttcaccgtctcagcaaacgaaaccgccacatttttcaggctgaccaaacccaaaaccacagttgcaaacctaaaaatgagccaaaagcaccatcaccttagaacgagtctgtctgcctgcacccaccgggcaggctctccaaggggctcgctcgctcggttggcacgtcggcccctctccgcccacctcctcatcaccaacatggtgcctggacccgcttctgtgacgctttaggtcgagcccccaggaaacggcactgcgtccaatgggaagtgacttctgccaccccttgaaaacgtcccagagacaaggaggcaccctgtcctgagaccaccagcccggaaagaagctgactgaacacacgtggcagtgagagccacgaagccacattcatttggtgtcctgaaatctggacagccctggtgcttttataaagtctgcactgaaaactcaccagccagcagagtccccgctctagtaacgagagggactttacatttaaagaaaaagagacactcaaccaaaaccaggagattctttacctcatcagacccacaaacagcatcgtcataaggaagttgggtgggtaggaaagccgggccttgtgctgatataaacagcaaggaacgagggttttcacacacccgataaccgtggtggacagcatctgcaccgcacctgcgggagggagggggccgaagacaagagggagaatcacccctcccgtgcctgcagtgggctccacccccggtctcccatcctgacctgggctcccccggccctcccgggtggttgctggctgctccctgtggggtggcaggtggccggcttccaccctgcccgagccgccgcctacctagcatgctgggctcgcctcccagcagggacaggatgtacttgttgaggaagagcgtgcagaagctgaagaagaaccacagcgtgaggtagagcagcgcccgcgagctccacacacccaagtctgactcgatgaccgtggtctccgtgatggtgacggtcagtacgttctcatctgtgccgccgtcgctcttggcaaaaacaatcttctcacttcggtgaccaaacagagagccccagctgagaggcgacctgcctttcggcttctcttcggagccaggaaccagctcttccagtgctggggttttcaccgaggacgacatgctgaagccacagccacgaacgattttacctccaggctgggcagcatgggtcaccgtgaccgcccgggggtggggccgcagcagggactccgggcgccaggaacgaggccaccagggcctctcccaggcaaagcgtagaagcagacgctaaaatattaagaaaaggaaacacatcacccgttttgaacatttaatgtcctcaaaggtttcaaccaccaatttaaaatcactttgaaaatgcaattgggccgggcacggtggctcacacctgtaatcccagcactttgggaggccgaggcaggtggatcaccttaggtcaggagttcgagaccaccctggccaacatgacgaaaccccgtctctactaaaaatataaaaactagcagggcatggtggccggcgcctgtaatcccagctactcgggaggctgaggcagaagaattgcttgaacccaggagacggaggttgcagtgagccgacatgataccactgcactccagcctcagtgacagagtgagactctgtctcaagaaaagaaaaaaagaaaatgcaatcgttcactgtccaaagatttttagcaattgaatcccgtttttctctgcgcgtgttggcggatccttgctcttgagagacggtctcctggcacacttgactgtcgtcctggcagacctggggctgtgggtccttcacgccctgcctggcagctgcaccttctcgatgggctttgtggctgccgctgccgggtgcccaggactaattccatgctactttctttttttttgagacgggagtctcgctgtgtcgcctagcctgaagtacagtggcgcgatctcggctcactgcaagctccgcctcgcgggttctcgccaatctcctgcctcaggctcctgagtagctgggactacaggtgcccgtcaccacgcccggctaattttttgtatttttagtagagacggggtttcacagtgctagccaggatgatctcgatctcctgacctcatgatccgacctccttggactcccaaagtgctgggattacaggcgtgagcctccgtgcctggtcttttatttttttgagacagagtctctgtcgcccaggctggagtgcaatggcgcaatctcagctcactgcaacctctacctcccgggttcaagtgattctcctgcctcagcctcctgagtagctgggattacaggcacccgccaccatgcccagtgaatttttgtatttttatttcattttttagatggagtttcactcttgttgcccaggctgcagtgcaatggcacgatcttggctcaccacaacctccgcctcccaggttcaagcgattctcctgcctcagcctcccaggtagtggggattacatgcacgtgccaccaaaccctgctgattttgtatttttagtagagacgggttttcgccatgttggccaggctggtctcgaactcctgacctcgtgatctgcccacctcggcttcccaaagtgctgggatttacaggcatcagccactgtgcccagcctcccttttcttttttttttttggctgactcatgggttagaattctggattgggcaaacacataaacattttgtacatgacgagagccagatttcatcatgtgagtgaagcgagatgcaaacacgaaaggaagtccttcaaggcagccttgtagtgaaaaaataaaaataaaaatgaaaaaaagaggctgggcacggtgactcacgcctgtgatcccagcacttcgggaggctgaggtgggcggatcacaaggtcaggacatcgagatcctcctggccaacacagtcaaaccccatttctactacaaaaaattagccgggcatgatggcgcgtgcctgtaatcccagctactcaggaggctgagccaggagaatcgcttgaacccaggaggcggaggctgcagtgagcagagatcgcgccattgcactccagcctgggcggcagagcgaaactctgtcccagaaaaaaataaagcttagaaacaagaggctatgtagtctcgagatagatccagccctatgaggcacatgtcaatcacagagggaaagctatgcacgcacaaagcatgtgtgaatcagagagaaagctatgcacgcacgatgagtagaagacaaacacgtcctgcaaggagacggaggcgcagggagggggtggcagccgtcctcccaagacatgaggacttctagttcagtctgagaccttggtgcagggctgggcgagtaaacaaatgcaaaagaataaggacctcgaggtcgggcgcggtggctcaagcctgtaatcccagcactttgggaggccgaggtgggcgcatcacgaggtcaggagattgagaccatcctggctaacacagtgaaaccccgtctctaccaaaaatacaaaaaaattagctgggcgtggtggcgggcacctgtagtcccagctactcgggacgctgaggctgagacaggagaatggcgtgaacccaggaggcggagctttcagtgagccaacatcgcgcctttgcactccaccctgggcgactgagcaagaccctctctcaaaaaaaaaaaaaaaaaagcaaaacagaataaacatacgtaggccaggtgcagtagctcacgcctgtaatcccagcactttgggaggcagaggcgggcgtatcacctgaggtcaggagtttgagaccagccttgccaagatggcgaaatcctactaaatacaaaaattagctggacatggtggtgggtgccagtagtcctaagtacacaggaggctgaggcacgaggatcgcttgaacctgggagacggaggctttagtaagctgagattgcaccactgcactccaacctgggtgacagagcgagactgtcttaaaaaaaaaaaaaaaaacaaacaggtctggtgtacgcagaatggaggcaccacgaattgctgaagaaggaaactttattcagtctatgataccaggacagttgtccatgctgccaggcaaaaagaaaaactggattctgatctcattatcagtagacaaacagcgacaattagtaacactgacacagccctgactgtgctgctggagggtccgaagcactctctgcacagcggtgaatccgcacaacagccctctggggaaggtgctgttatcacccacgtgagacacacgaaggaaagacacggcttcgcagcagcagcgtcatgattcgaacccaggcggcctgctcttatgataaacttaaatgtgtaaaactttatgctcaggaaaatataagagaatgtcttcctgaccctttttggggtaggacaataatttctctaaccaaaccccaaaagcatgacccattaaaaaaagggtcaggtggactaacttggctaaatgaagaattctgtttcaccaaagtacactacaaagtgggccaggcgcagtggctcatgcctgtaatcctagcactttgggaggccaaggtgggcggatcacttgaggtcgggagctcgagaccagcctgaccaacatggtgaaaccctgtttctactaaaaatacaaaaattaaccaggtgtggtggtatgcacctataatcctggctacttgggaggctgaggcaggagaattgcttgaacccaggacggggaggttgcagtgagcccagactgcgccgctgcactccagcctgggcaacagggcgagactctgtcttaagaaaaaaaaaggccagacttgtctcacgcctgtaatcccagcactttgggaggctgaggtgggcggatcacccgaggttgagagttccagatcagtctgaccaacgtggagaaaccccatctctactaaaaatacaaaattagccaggcatggtggcacatgcctttaaccccagctgctcaggaggctgaggcaggagaatcacttgaacaggggaggcagaggttgtggtaagccaagattgtgccattgcactccagcctgggcaacaagagcaaaactctgtctcaaaaaaaaaaaagaaaaaaaatatatatatatatatacatatacacacacacacacataccacaaagtgaaatgaacagccacaacctggcaaaagatacttgcaacatgacaaaggattaataaccagaaagtataaagaattcctacaaaccaattagaaaaacaggcaaaaaaaaaaaaatattggcggggcatggtggctcatgcttgtaatcccagcactttgggaggccaaggcgggcagatcacctgaggtcaggagttcgagaccagcctggccaacatgatgaaactccgtctctaccaaaaatacaaaaattagccaggcgtggtggcaggcgcctgtaatcccagccacgcaggaggctgaggcagcagaatcacttgaacctgggaggcggaggttgcagtgagctgagactgcgcctgctccagcctgggtgacacagcaagactccgtctcaaaaagaaaagaaaaaaaaaaaacaaaacaacatatttcacagagaagaatttatgtttttggagaaggagtttcgctcctgtcgcccaggctggagtgcagtggtgagatatcagctcactgcaacctcaacctcccaggttcaagcgattcacagaggacaatttctaaaaggcaaataagaagcaggaagggtgcatgctccttctctactgccctgtaacagtcattccacacttaccacctcaaaacaacaaatgcttttgatgttggctcctgtggggcagcaatctgcgggaagcttagccaggcacctctggcttaaggtccctcctgaagctgcagtcacaccatggaccagggctgtgacctcatccgaaggctcaactggggctgaggcccacctctgagctcactcaggtggacgctggctgggttcagttccttgctggctataggtggaaagggcccccaccagtttcttgccagcttctccacaggacgccccacagcctgacaggagctttcatccagcaagctcatcagggagtgggagagagcagccaggacaggagcccaggcctttctgaacctcatctcagaagtgacatccttcccttctgctgtctgggcacagctccccgggtggagcccgaggactagaaggaaaagaaaacttggatttaaaatgggataaagccataggagctgctcgtcccaccacaggaatctcaacgccgggttactgacaaagcgtcactttgcacctcgtccaactgtgcagacctctcctagccaggcccctgcaccagaggttaagaatccgtgcccctggtcaggaagtccaggtgggttcaaacggccagcagggaatttcaggcaaaatgtgtcccaaatcttcaaaccacgccccagaactcagacctccccctgggagttcgtcccaaggaaaccacctgcaagaggctcaggctgcaggggacactccgcttccaaaacccggaagctggagaccacacaagtgcccaacgccaaaggcaccccgtggagggacgccctgtgccctcccccgaccaggtgacccgctgcgccctacacatcttcaccaggaaacatctgttatcgatgtggacgaagcgcagcctgcactcccagatccgctcattttcgttctgccctccgttttacgattcgcctacactgaaaatgcgtgagtggagtggaaagccttcctactcctgcctcagcgaccccttctaaaatactgcctcgtttggcctgaaaatgtgatttgcaggcttcctgagcaaagtagatttcactccattaaagaaaaaaaaaaagaaaaggcaccgaacggggctcggctgtcgggagttttgctttagttttttgcgtgttttgttttgtgtttttttgttgttgttgttctttttgcggccacgcacaccgcgttcccaggcttcagggcgtgggggtcgccgtggactcccggacgtgaaaacgcttaaagccagctgggaaaaccccaccagcgttttccgcgcacagcgccagccataggaaaggacccccaggagcgaatccgggcagggaaaccccggacgcccgcacactcagcatcagtaccggcacccagcacccagcaccgagcaccgagcacgcagcaccaagcaccgatcaccgagcagagcaccccgcacgcagaacccaccgagagcctgatgcagtctccgccgcaggcatagcgctaggccccggcgccttcacaacaaagggacgctggcgggcggggcctaagaggtgcgcggtggaggggccgggcgcgaggccgcggagacagctcggagctcggcactggggagtggcacagcgctggcggatccaggtgggcttcacggggcgcccgcgggaccggaaatgacgcgcagaaccctgcatcgggctcctcgctgccccgcgggcgccgctcctcagtgccccagagccacggagccggggaaacgcgccgcggcccacaacgcccccgcggctgcccgttggttccgcccgagccgttctactccaggcagacgggaggagaaacacggcgcgctcagcgtcccctgccccgttggttctgctcgggcccttccactgcaggccgacgggggtggaaacacgcagttttttttttttttttttttaaggtctagggtaacacggggcttttaagtgcctctccgcggccgcctggtggtccagcccgggccgctgcagtgcagccacacggggagggacacggcgcgccgagtgctccgggcggccgcacgttggttccgcccgggccgttccactgcaggcagagggagaggacgacggtgcgcgtagtgcatccccgtggcccgttggttccgccggggccgttccactgaaggcagaaggggggggaaccgtggccccaccccccgcggcagcccgttggttccgcccgggctgttccaccagcggcacttcagggcgggatcggccagtctgtggaggcagcggcctctaagccccggagggtttactgcccaggtttgggttccaggaataagaaatccactgaataggcttaacttagaagacacaaaggcgcctcctggcggaagtggccacgctccgcccagcctgagggaaagctgctctgacagctgggcccggagctgcggggggcggggccgccgcgcggggtgaggactcgcctcagggcgctgattggctggtggcgcgctccggggcggggccttcgtatccaggctggcgtcggggctgccgcgggacatccggagcagacacccgcgggcgcgcctgcggccccgaggacccccggctccggagcttcgtcgagcgttttcctagcgttactttcccaaataattttcaggaatgaagttacggctaaagggctctttagagattacttttgggccgggcccggtggctcacgcctgtaatctcaacactttgggaggccgaggccggcgcatcacgaggtcaggagcttgagaccagcctggtatggccaacgtggtaaaacgtcgtctctactaaaaatacaaaaattggccgggcgtggtggcgggcgcctgtaatcccagctactccggaggctgaggaaggaggatcacctgaacccgggaggcggaggttgcagtgagccgagatggcgccactgcactccagcctggcgacagagtgagactccgtcaaaaaaaaaaaaaaaggaagaaagaaaattataaaatgaagtgaaattaacgcagtggagtgccacctgcctgctgcctgagttcactatccacacggagttcataaatttgagagcagtttacaaagtagattctcctactttccaggaaacccagaaatgtctggtgatttgcccaacagtctcagctgttgtggtcagcagggccgctgtggtatccaaatgatttcaaaagcagatttataaaaagtactccttgtttttttttgagatggaatttcgctctcatcgcccaggttggagtgcagtggcacgatctcagctcactgcaacctccgcctcccgggttcaagtgattctcctgcctcagcctcctgagtagctgggattacagatgtgtgccctcacgcccagctaatttttatatttttagtagagacagggtttcaccatattggccaagatgttctccatctcctgaccttgtgatctgcccgcttcagcctcccaaagtgctgggattacaggcgtgagctaccccacgcccggcctttatttttttttgagacggagtctcactctgtcgcccaggctggagtgcagtggcgcgatctcggctcactgcaagctccacctcccaggttcaagagattcttctgcctcagcctcccgaggagttgggatcacaggcacccgccaccatgcccagctaattgttttgtatttttagtagagacggggtttcaccgttgttagccaggatgctcttgaactcctgacctcatgatccacccaccttggcctcccaaagtgctgggattacaggtgtgagccaccacgcctggcctctcaaagtttttatagcaaagccttacatttcatgaggaaccatgcattttattttatttttgagatgggggatctcgctactttgcccaggctgggctcaaactcagggctctctggcctcagcctcccgagtagctgggtctgcaggtggctgtcaccgtgctgggcctggggtgtgcgtattaatgattttggaatagtgtctggaagcctgtgtgccttcctctcttcctctccccagaaggacctcccacctcgtcctcccaaagtgttgggattacaggtgtgagccaccatgtcccctctctttgctattttgcctgggaggagtgtattaataattttaattttaaatttctttgattatgttctagtttgattattgatcatttacttcttagctatttatattcttccttgagtcatcggtttctgccctttgacaatttttctgtgaatgttttgtgttgattatatgagctttgactgtattgagaacatccacgcattgtattattgcaactgttttcctagttgagaacatcgacctgctgtattattgcaaatgttttcctgcttgcatgtagtcatttgttatgcatattaatgaatttctatccacatgacgtggagtcagttaggaatcagttaggacgccctcgctgtgtgggagactgatgggtccaggcgctgtgcaaaccccgcctccaaagtgcatccttggctcactgggaccttccgggttgtgctgctcttgcttcacagcctctctgggtctccctgccgtctgctgacctcggggcagggtctacccaggctgagcggcccatgggctgtgggattcctttcctctgccttcaggtcctggatgatgtagaaggcaggaaggaaagcagtcatggctagctctgtcctgcccccttcggggtcccccccggcccacaggctcctccttgtcccccagccagcctcagtctgggtctgggctcccgctggggaggagggtgagacctgccggcccaaaggagctgaagtttcccaaggggcgttgaggacagcagggaagtgtggggtgtgaactgaggccccagagaagggtctgtgccaaggccccatgggtggggaggaagaaggaagcgtccccacctggagacccagcctgcaggccactcggccacctgcgcagaagtaggggagcagcagccgctcatgcccctgcagtttgtcctcatcagcaggtggggaaactgaggccggggagttctccaggccaaggtcactcacgggcaagttcccgcagcctttggaccctccatacacgtcagggccgctcatgctttcctgggcccttcactggtttggaggaagcttcctgttgcccagagcgcactgcctgtctctgagtgtatgtgtctcagtggcgtccatgtgtatttttctctgtgtgtatctgtgtgagtctgtgtgtgtggtgtgtttgtgtctgagtgtgtggtgttagcgtgtctcagtggcgtccatgcatatttttctgtgtggtgtgtctgtttgtgtgtgtgtgaatctacgtgggtgtttgtccatctttttgtctggcctcctgtcccctctgcacagagcagctgggtggggatgctggtcctgggggcttgtcagcaggatgtgggcgtggggcagccctgggtgaggcctgagtacaggccccaggtgcctcctgcacaggggtggctgagccagctcctctgtggctcccgggtccccaccgccggtcactgggcaccacctgtcctggccacccactcctgcccaccctgctctccgcaggggcctccttcctctttcagctgtgcgccctggttgtggaggctcctaaggaggttgtggcctcggtttaccacctgccttggctccttggtgttgccagaccctgaaggcagcccatgccctggctgagatccttctggggcgggatgtgctggaagcagctgaaccacgtggtgatgtaccagctcctgctgtcccctacatccccagcaccgccagccttccctgggctcctccggccggctcctctaccctgtacccgccccaccctgctaccaccccccaaccagacttccagctccaggcagggtcgcagcctcctgggctcccagcaggacaggcctcacccagaccccgcaggagccatgggacttgggctgggtctttgggcctggctgcagcccctttggacctgacctgaggagacaccctggctgtgggaggcagggtgggggtgccgggcccagcacagaggtgcccagggtgcaggctggcactggcccggcagggaccgtggatgccgccgtttcaggctcgaaaaggtttccatgccccagagcctgagcccggcagcccccgaggatgtcttggggactctgtgctccccaaagccgagaaggttaggcttgacccacagcctcttccaggccggggaggcagaggcgctccaggtcggtagggcggggcccacagcccagggtttcacgtccccaaaacggggcagggtgctggaggcgcaggtgtccacagggtggtcgttttggtctctcctggacttgcacgcgtgtagtgcagactggctgccggcaaagccctgagccacattcatctgggccttgttaggacaacagggacggtgcggggtgggggggttgcggggcgcaggaccacgtcagtggagggagggaggccgatatcggtgcccaggctgggcccaggggccagcgggtcctcacctggcttgtggctgcccctgttaggcagcccggatggaggggctcttccagccctgctggccccgggaatgcagggactcaattccccctggtctcagtggctcttccgggagcaacacagcctgcccgagtcgacaccacccctcgggtttgagtcccttctgtctacccctacccccgccagggcactgcccccttgcccggaagaggcagcggcacccccagccccttggggaggatgccctgccggccccacactcggtggatgggcattttggggctaggatttaatgggggtgaccctgcccgacccctctatgttggttccacggcgtcagaagaaagctgttattaacccagcttattttctacaagtcttgtttattgaaaggatctgaaaagcgtaataaggctttcaatgacatttaatacattttcaagaaattaatatgaaacattaaaatttacttcaaaaatccaaagttttctagatcattcccatctcacgctgctttagaggtcagttcacaccttctgtgttcagatgagcggctggaattctgaacactgccgtcttccagccctaacgctgggcgctggtccctctctcctaagcccacggctgggcttcccctgtgcccagggtcatggcggacttcaagccaggccggctgcccagaatcacactcagggtttttggacgctcaagtccacagatgctgaggtgcccagacgagggtgagcagggagacacatgcctcggagaacgtgcccaggctgggccaggcggctgcgggaagctcctcacgggcagaggagaacgtcttgtgccttccttatcgatctccagcagatgagggcaacttcgtgtgcaaaactcagagagcagttactcaaaaaaaagacacccgggcagcagtaaccaggacaccagggtccgaccacggcctccacacacctgtgcccgtggaagacgcgggcgccggggtaggcagcatccacgtgctccacagctgccggtgctgggcaggctggagactcacgggagaggcaggaggagaatcagcgtgttgagtccctcgctgtgttagtgtgaaaaattctcattacagttgcaaataaaagggatcacgatcactagccccggaaaccctcatctcccggaccatcaggatcgcactgaacagaatggtcccctaatggtccctgaggacagcgtcttgcagaacataaatgtaaacattgaatggcagacgactcccttccccttgaaatcttcacaaaagtgtgtacgagaaagtatgtacatcagcacttcagaaagtttaaaagagtctctaaaaagtatatacaggatttaaactaccttcctgggagcagaagctacgtgaggaatgtgtgggtcgctggcgatgccagcccccttcccgctgagtgtcccagactcagtgctggcctcaagcggggagggctggatggcaggggacgcatccaaccctctccagaaactgagcagaacaaaaccgccttgccagccactggcaagaccatgctttcaatggcgcctccgccaggggcttccctgcagaagttttaggggaagaggtgcaggtcaaggggaaaagcatggcagctcaaggaaggtttttggctgagacatttattatcaacattgaaggacaggtcgagtcattctgactcctctgaatttcaaccgactgatttgcggaaaaatatcctggcatggaaattgcggcagctggaggccgcgctccagggacccaccgcggggtgtcagcaggacagaagcactcccagcccatttctcacgcttctttagaaatgcaaaaaaagtcagacattttaaaaaaacagctgatctggacaaaaggcagacccaggctctaacccagctacagaaaggaagtggccgtgccactgagacaggcggtcacagacacacgcagattggtctgtccccagagggcgcttggagggcagcggaaggattcgggcctggataggggcttgacctagccctcctcctcctcctcctcctcctcctcgaagtgggcttgcttcttccggacgttccaatgcaggcactgggcgaggctctcaaaccagtcgctcacggggtcccgcacacagatggaggggagcgggtagcatgaggtagtgatgctgatgctgggacgggagagcagcagcctgagccagggcttccagaaaggcccacccccggccaagaacccttcctccctccctccctgggaatggccgggactcttttcctgtggggccgggcagcccctccccgaggcaggcttgagcagtgccccatgggtgctgggacagagccatcccaggtcctggaggggacggtgcagggaactgacaaactctgccccagggccctcaggggtgaggtcccaggaggtgggtgggggtgggcagcagtgccaggggggacaccctcaggcctctgctggggccaggcctgcatgtgccaccgtatgcgacccgctgcccccaggacgggtgccccgactgtgatgctgcaagacccagggactcaggccctgtggtgccctaggggacaagctgtgtctacaggccaaccgcaagagggcaggcgctgcctggcccggggaggaggttggcaggcagcgcccagcccggcatgcagcccacacctgtctccatggcggatctcttgtctcttccgtccatcaaaggacacccatgctgtgttccttgcttcaggtgacagcatgatctgagggtcaagcagggagaggtgtgggcccccagctgtggggaggacgcttctaggcacccacccctgagtgctcgccagaggtcaaggttgggcagctctgaccctgccttgcggacggtgcagtgcacgtcctacaggcaccggcccagctcagcaccgccagagaccaacaatggcagaaagcccctcagacccgggccctgggcaccttgatggacagaactcgggcaccagcaagggaaggcttgcatctgagggggcacaggatggccctaggatgacgaggccgcgtctgaggctggagccagcatggcagagcggggtgctaggtcccggctttgtgttgcacggggtcaaatgactcacaaaccggaaaaggagtgtcgttggctctgaccttcagctcgacccctgcggggaccacgatgggccggaaggacagcgagtgggggcagatgggcgtgatcatgatggccggcacgttggggtggatcatggaggccccggccgcggccgcatacgccgtgctgcccgtcggggtggacacgatcactcctgacagggacaggcgcaggcgtcactcccgcccgagggacgctcagggccccaggacagtgctgcgggccttaccgtcgccctgcaccgtggtgatgaggtgtccgtccaggtagacatccacattggacaggtaggaggaggggcctctgtcaatcaccacctcattcaggacctggaggggcgacagcattgcacactcagggcgggggatgccgcacggctcgcagacaccctccgtctcacccagccgggctctccggaaggtcctcatccctgggaccgaagtcgccccaccctgggcccctcaccgaggccgaggcgcctccactcacctggtactgcatggcctgcttcccgacatccatgtccaggcctgcagcctgcgagccgttctcacccagcccattgtgcacggccgtcttcttcccccggagctccttcaccaccctgaccttcagccgactccggagaacaacagctgcgttccctgaggtccagcaggagtcagagggcatgcatcagggaagtcagtggggtcaggggccccaccccagggaggccagtgggagtcagagggctctttcttctcccaagttgacacacttctgtgcctttttctttttattttgagatggagtctcactctgtcacccaggctggaatgcagtggtgtgatcttggctcactgcaacctctgcctcccaggttcaagtgattctcctgcctcagcctcccaagtagctggaactacgggtgcgcaccaccacgcccagctaatttttgtatttttagtagagacggggtttcaccgtgttggccaggatggtctcatctcttgacctcgtgatccgcccgcctcgacctcccacagtgctgggatgacaggcgtgagccaccgcgcccggccgacacttctgtgccttctgagagtgagaatcagctcacttctgcccaacacacatggcagcttcaacctgtgatctgctgaaacttctcagtgtcagtaaaaggtttgaaccactcaagatttagaaatccctgaatcttgaaacctttaaatgttgctccatgcatcattaaatgaaaataaaccccccgcaagcaagcgagacagcagcgccatgatcagagctcctgtgggctccagaacattccaactcaccctctatcacctgagtaacttgggactgaaagttctcaaagctgaatggggtcaggaagcccagggagcccaggtggaaggccatgaccggagggacgctgccctgtgagccgacggagaggtcactcagtgcccacgccgtgcacccccgcaccacccagctttccagcagcacctcaggagggacccagctctgtggggacagcaccccgaccctctgcaggagggactggccatgtggacaagcggagggggacgtcgcaggccagggtgggccgggccaccagggccaaggttggtgtggggagctggtgaggaacaaaggtggcagggctgagcggccccctgggcacggagggctgggggagctggcgagggcgggtgggaggcagccttggggtcggagcctcgcgccccacaggtgctaatggggagatggggagaaaagcagggcgggctgcgggcatttccggtgtcaccaacatgcagtgggccaagggcagagccagggtcccccacacagcgtggccctacagccccaggggagagctgtgctgctgagaaaccaggaagaggagctcaagggaggcccagaggggatgggccagtaggcgaggtcgtttcccaggacccaccaccctgcgccactccctgctgtcccaggcgggcgctggccacccccagccgtagcactgtgtccacactgcccctggccccaccgtcgcaccccaccgggctgccaccatgggcctcagtgctggccgctctaggtgactgctctcgtataaaggggtgaaaagcaatggaagccatgcttgtgagcccctcgttacgcagcacctagactagaacctggtgtgggtctggaaatgtcagcgcttcacctggaaaagcgaggaagcgtacagcagcgtcccgtctccccccaggcagatgatgaagtctatctgattggaaatgtcatcataatctaggaaacacaaagcaaaaccaagaagaggctgtcacacagtggcccctctgtggcgcagtgcgcagacaccaatgacaagggcaacagtgccagaagcttccaatggggcggggaactgtgctggagaaaccaaggacagagctgctgacagcccaccttctcgaaaggtacagaatttcttcttcactgccccaaagctttcatcgctggcgatggcagggtcttctagcactttcttttccacatacacgatcatgttctcctggaagcaaagtgccaacctgctcattccacctgcagaccccaccctcctgcagggaggttcccgactcacgggcgctgtggtcagagacctggcatcgtggcctgcatgcccgcccccccacgctcacgctgaaacttcatcaccaacgcgccaggaggaagcaggacctttaagagatgactgggcggagggggctccctctcaggaattgactaaggctgttatttcaggagtggctttcctgggcgccgcaacccccacgcctgctcttctgaagagaagacacagcaggaaggcccacgtcagatgtggccccttgatctcggacttcccggcctccagggccacgagcccaccagctcattgttggtcacccagtctggtgcttgccatggcggcacacacaaacccagacacccggcagatccccactcagtccccagttccagacaagcagccgttgcccagcacttgaggtggttcccatggtctcacggggcggtgatgtggatggaggcccccccaactccatgtgcaccccaggcccccttcccccctgccccgcgtgcctccatgaggtgcgtgcagagctccttgaacggctgcagtaggctggcatctctcatcttcttgatgacaaggacgctctttggggacttgttccacgtcagccgctggctcgcggggtcctgaatgtgcctttaggggaggagaaaagagttcacaccagctgcgatctccctcttgcggaaaaggtgtatgacttagaaaataaaaaaaaaaatctttaaaaaggtgttttcacctcccagggaaacgtgctcggtggccacgggctcacagggcctagggtcgcgccacagagacagggtcaggggtcagtagggtccggagtgaccacctctcacctgcttggcccatcacacgcaggctcaggcccacaacccccacccgggcaccacgctgacccaagtgcacgcaccacagcccttcccagcccccggccacttgcctgcctggctcctcagtgacgctggtggggcagaaatgaccacgaaagcccatggctgggccactctttgcttgatgccctcctcaggcccccacgaaaacccaaaccagttgacatggtgactctgtccctaggatcctctgcacacagtttctggccccacgggagcccaggacccctcaaggacccgcttccccccctgcacacagctcactacctccctgcatgaacggactttaacctcactcactctcacagtaaaaatcacaggtttaaaagtccgtggcagccctgacacagccacccgcgctttgctggctctgaccccgaccactgtgcccggtgtttctccacaggcagggcccaccccggtgggattcccattaccacgttagtcacagaaaacatcccagcccagaaccgggaacacacaccacggagcctgctcctgttcccagaagccaagggagggcgcagcggggctggccaccgtcgtcagcgctcaccgcctatcctcagccccaaaggacaagttcttataccaccgcgccagccagctagttccaagttgcccaatcgagaaagctgctgcctgccatgcctcttcccagcagtgacttccccaggagtgtgaccgtcccactaacacccccagaaccacaacacagacgccgatggcagccacagggccacagaccttagcccatcgcttgtgaccttcggaagctggtcagcactcaccctgtgcaggcattactgggaggcgtggggtcactcatgccatcccctatgagctcagcacctgccgggtcacacatgtggctcgcgaggtagcccctgcctgctgggagccggccagtgtgtccacagcatccaggccacgcttggcgaacacgcggccgccccatcggtatggtcctgactgtgcgcccacactagaagcctaagctcttcatactcaaaactcaaagcaaaacacaattgtgatgagacttggtaaagttgttgtaaaagcaactaagtcaaaagagcttcctacacttataaaaatcaaacaaaacaaaacagtttcctcattggtcacatggtcctcctgcctaatcccttctgaaaaaaagtcctcagttcagcagcaaagaggccacacttcagctccctgctcctaactgagccgggtgggaccaagccctctgttcccgtggcctcagacctggccaagtacccagcctccagcctcgccccagcactgcgccagccaccgctctggcccgcggaaccggctgggccccagggaaggcaccctcaggccacagtcaggtggaagggcgttccctgcctcctagcccgctgcgtcactctgcttggctccggcccaagggcgtgcaggtggctcacggtcctccggcctggtcagccagcaaagcccccgccctgcacacggctccccctgctctccccgccaacagtcaccactgacccagtggcctggcctacacccattccagccctgaggctcagctgagcccagccagagccaccagcagcggcgtcgtacaccggcccaggcacccaccgctgtgtgtgaccacaaaccagcgcctcgacctcttcctgggtcacctgcaaagcaggacaccagcccttgcaggcacgcacggctgtgggtactgcacggagagggcagggggtggcgtgaagcttgcaggcacacacggctgtgggtactgcacggagagggcagggggtggcgtgaagccagcatggccacagcctggcccgcctggccagctcctactgagactgtctcacacatgggtggccacgcacactgtgacacacgggcactcacgcacctccacaacacaggcccaccaattccctggacaacaaaacaggaagcgggtgccctcctcaccaggcgcccccacagggtcttgctctggactatcagggaagacggaagttcagatgcatgggaagccctgcccctccacagcggggatgggaagcgggaggttatgatcccagagacacagagcccagagggggcgtgctcccatgggggtgccgagaaagctgcatgcccctcaaggctgccccacaaacccaccgcttcctcctgcggggctgtctggcctcgggcagctcggggaccactgagtacgccctggtctgagggctgaggcagaacatgcacctgtccggtgaccccgccctggcccgagtgactgacggctggtgaaggcagcagctgagatgcgagtgacaaaggagtggctctgccaggaccaggaagtgcagggagggcaccaggcagcgggggagaggcccggtggggtgccagggacacagcaagcacaggatggcgggacagagccacggcggggccgggagggcagtggagcactctgggtcacccacgtggctgctgtgcagggaagggatggtgaggccgcggcgagtggtcaggagtccacacagcggagggcagccgggcaatagtgcaggggagctgcttggatattttgggatcaaagtgacagaatctgcagatggactggatgagggaaagcaaacaggggtcgggccccccgcctcaggcatttggcagcagtgacaggtcacagacactccgggaaccagtggcactgaaagggctgggcctcaaaagcacaagtgcgagtcacttccatcctaaggggctccgtcagcgtctggagcagcaaggccaacccccgtcctgcctgggacgcacgctgccgcggggcccacactttgcagagcagctcctcggatgactcccccgtggctcctgggacctgaacttcggtgacagcccagggctggggcctccgtccctgctgtgcgcccccagcctccatggcaccggtgcctgtcagcaaagggccatgcagtggccgcccccgtatcacacggccgcattgcgctttctggtcaacagtccccagcagcctgcgcgctggaacactcggcccttccgcatggtcctcccttgcagaaagtgaagcatccatgactccgtgaaggaggaggccctgaagagagcccgttctgcacagaggaagagagcccgttctgcacagaggcctgagagctgaggcaccagtcccagaagcaaaggcttctctggggaagaggcaatgaggatgtctaccaggtgcagaatacgactctcagggctggctgggagctcacttttttctctggagacagtcttgctctgtcgcccaggcggaatgcactttgataatcacagctccctgcaatctcaacctcccaggttcaggtgatcctcccgccccagcctccttggcaactgggactacaggtgtgtgcaacgatgcctgctaatttttgtatttttctgagtctgagtcttgctctgtcgcccaggctggagtgcaatggtgcgatcttcggcttactgcaacatctgcctcccgggttcaagcagttctctgtctcagcctcccaagtagctgggattataggcacgcgccaccatgcttggctaatttttgtacttttagtagagatggggtttcaccatattggccaggctggtcttgaactcctgacctcgtgatccgccccccttggcctcccaaagtgctgggattacaggtgtgagccaccgcagctgaccaatttttgtgttttttgtagggatgggctttcaccatgttgcccgggctggtctcaaactcctgggcccaagtgatctgcctgcttcggactcccacagtgctgggactgcaggtgtgagccactgcgcccagcctggattataattctttacacataaaacacagatatcagatcgatcactgttgcgtttttcccatgacactatgacgggcctccaggcagaatgtgttgacaaactgaaccatcaaatagcaaacgcaacccaccccagaattctcactcactcttaaagaaacaaaaaggcagccctgaggatctcatgtggaagccgccacacccacgggctgtgacccggtctccaggccccggctcgcctgccgtccactttctcaaagccactggaaaagccacagctggggagcccccgctcggatgcctgcactcagggggttcagggaggacgcccatgtggctttttgtttaaatgacctaaacatgtacttctcacatgaagtgctagaatcttcctcaacacagcgatcccacaactccacacacatcccgaggactcccccatcccatggcccccggcactcacatgatggtctaggggttctctcccttccaagaaccccccgtcctggggccccagcactcacatgatggtctgggggttctgcagcacacaggcctttggtccaaaagtggtcaccgggcatggcccatgaagagagcgtgtcctcctgtggggagagggcagtgtcagagccaccagggcctgaaaccagacatgcagtgacagacacagatacagaggaggttacacggtaaggcatacatgcaatttgaaagatgccaactccatctgcccagcagccacacaatagcccttggaaggttctgcccaggtccatggctgcactggagcggcacctgtgaggagcacgcatgcccacgcgccgctcagatcatgacccaagccggggagagcttcagcccaaacaaggaaaatgccagggccagggccagcctgggatcagaattcctcagtgtctccaggacccctctctagatctgcatttgggactcaaaacctgagacaacatctcatctctaaatcgtctagattaaaattctagcacaaatgttcactctgaactcatgtcaataaaaaagacgtaggccgggcgcagtggctcacacttgtaatctcagcacttcaggaggctgaggtgggtggatcacgtgaggtcaggagtttgagaccagcctggccaacatggtgaaacccccatccttactaaaaaaagaaaaattagccaggcctggtggcgtgtgcctgcagtccgagctactcaggaggctgaggcaagagaactgcttgaacccaggaggtggtggttgcagtgagccgagatcgagccactgtactccagcctggctgaaaaaagtgaaactctgtctcaaaatgaatgaatgaatgaatgaatgaatgaatgaataaaagacgccagatgaacggctcaacaactttcctagtgatttaaacatggccaggtcacagttaaatcacccagccaggggctgtggcagccgcacgcgtcctggggagaatgctgtcaggaccgctgtgctcctcagggtccagcactgaggctgccctcgtcctaggtgcccgggagcctcccagtcccttcacaaactcagaaaacttgcacacagctggccaggcaacggcccaacaaaatcctcaagtcccaatgcagaagaacggccttccgctgcctcgcagggccagacaaccccaggagagccgtggtgccctgagggctgctccacaggtgacacaggcgtggccatcagtggtcacggacttgtttacctcagccttttaaaaattggtaagtacaggccgggtgcagtgactcacgcctgtaatcccagcactttgggaggccaaggcaggcggatcacgaggcaggagattgagaccatcctggctaacacggtgaaaccctgtctctacacaaaaatacaaaaaattagccgggcgttgtggctcacgcctgtaatcccagcactttgggaggctgaggtgggcggatcacctcaagtcaggtgttcgagaccagcctggccaacatggtgaaatcccatctctactaaaaatacaaaaattagacaggcgtggtggcatatgcctgtaatcccagctactcaggaggctgaggcaggagaatcacttgaactcgggaggcagagcttgcagtgagcctagatcacaccactgcactccagcctgggcgacagagcaagactccatctcaaaaaaaaaaaaaaaaagaagaagaaaacgaagtacattacaaaagaattttacttacttacgaactgaaaagattattgcggaaaacaatgtttctcgaagtgggtgttgggatttaatgtttccttcccaaggacaggctatgcttgggcgtatttggctacctcctcccccacctcaccctgaaggcgcctgtcactcactatggaggcgacctctgacccagggctgctgtcatcaggttcagaatgcaacagaaatggtgcattatgccaaagaacccacaggaaaaaaaaataaaaccccaaagcaattctgttcacgcagtcactgcgctggggtggcctggaggtacaggacaacgacccccactgacaacgaggcaacgaggcatctgagaaaggctgagtggtgacgtggtgcctgcgggatgaaggcagccaccagcgctcgtagcctcctggctcaggcagcgactctgtagacagaaaacgtgggagtagcctgtttctccacggctgccaccacgtcagaggcgctacaggctctcccatctcactgggtaagacaacatgctttctaagactacttttcaccaaaaagccccccttgcatttgatagtcgtgatccttgttaggcagcgccggctctggcaagcttccacctaaaactcaccacatttaccatcaccagaaccgagagcaccatccccaggcaccatcacagctgtgcttgtgcggccaccgtcatgcaaagcccggggcgctgttgcccaagcagcattgtgcaagggtgagcgctgtgggcactcttggcacaggagggagccacttgcccaacatgtgagagggctgggcccgcccaaggccacgctcataactctgcctccaccagccctgctcacagtgcagaaccccccagccttcgcctctcaaaacaagcagagccaagagggatgtcccctcacaccccagtgacttctgtagagcaaatgtttccaggccaggcacagtggcttgcaccggtaatcccagcactttgggaggctgagacgggcagatcacctgacgtcaggggttcaagaccagcctggccaacatggtgaaaccccgtctctacaaaaatacaaaaattagccgggcatggtggtgcacgcctgtaatcccagcttcttgggaggatgaggcaggagaatcacttgaacctgggaggcggaggttgcagtgagccaagattgcgccactgcactccagcttgggggacagagcgagactcagtctcaaaaaaaagtttcctctccaagtgcgcttcagtctaacatcaagggtcagcgtaggcgccagttagatggttctgtgctgatacagacagatagagaaacacggtggcaccctgtgcctgtgctggcacctgggaacgtgcgccaggcaggtgtccatgggccaggatcccccttcaagggcacagcttcacctgggcaaggacccagcctcaccttccggatgcatcgacgcagactactcaggagaattcttcataatcgttttaagaaagaatattatgaaatcagacgagaaaaaaaagaggaaccatccctcccagttgtacctgaactccttggtgctccccagggcgggcgaggcagacaggctgcgagacttggcccggccccggatggggtggttgtaactccaggtctcatcgccgtggcaggccgagcagcagtaagcagccgcgtctggactcaattccttattcatggtcattttttcttgttccatttccattgtcaggaaatgagaacttcggtcagaaaaacactgatgccttaatttaataaaataaataatgtaaataaagtaaataaatatgtatgaaacaataataatttacacatacatatgttccatttcatcaaggggaaaaaatggctgaagtccaatttaccaaagtactttgaaaacagactgtttccattgcaaagatatttaagaactactctaggtttttggctgggtgccgtggctcacgcctgtcatcccagcactttgggaggtagaggcgggcagatcacttgaggccaggagttcgaaaccagcctcgcctgaccaatatggtgaaatcccgtctctactaaaaatacaaaaattagctgtggtgggcgcctgtagtcctagctactcggtagactgaggcaggagaatcgcttgaacccaggaggtggaggctgcagtaagtcgagatcatgccattgcactccagcctgggtgactagagtgaaacttcatctcaaaattttttctgtaaaataatattaacaaaaaaaattgtttcaaaaaagaacaaaatagaaagtcacactgtgtggccaggtgtggtggctcatgcctgtaatcccagcactttgggaggctggagagaaaggatcagttgaggccaggggttcaagaccactctgggcaacaaagaactcttctctagcaaaaaaaaaattagccgggcatggtagcccatgagcgagaccctgtcttaagaaaagaaagactctggccaggtgcggtggctcacctgaggtcgggagtttgagaccagcctgaccaacatggagaaacccccatctctattaaaattacaaaattagctgggcgtggttgcgcatgtctgtaatcccagctacttgggaggttgaggcaggagaatcgcttgaacccgggaagcggaggttgtggtgagctgagattgtgccactgcactccagcctgggcaacaagaacgaaagaaactccgtctcaaaaaaaaaaaaaaaaaaaaaaaaaaaaaaaaaaaaaaaagacaggctcttttctcgtaaacaatacaacacattaatgagagagaaagtgtgcaatttcaaataccctagtccagaaaagctgtcaaataaaattgaaccagcagatatgttgtgaactccatgccttgcatcgtgaattcagcgccaatgaaatatttaccaaactgaccaatattaagcctcaaagaaaactggtgaggatagaaaacctcacccttttttcccctttttctttttctttttttttttttgagacaggatcccacctcagccttccaagtagctgggactacaggagtacagcaccacgtccagctaattttttttcctttggtagagacagggtgtcttgctctgttgcccaggctggtcttcaattcctggcctcaagtgatcctcccaactcagcctcccaacacagtgctaggattataggcatgagccaccatgcctggcctagaacctcatctttttttttttgagacagagtctcactctgtcgcccacgctggagtgcagtggtgtgatcgcagctcactgcaacgtctgcttcccgggttcaagtgattttcctgcttcagcctccctagcagctgggactacaggcgtgcgccaccacgctcagctaatttttttgaatttttagtagagatggggtttcaccatgttggccaggctggtctccaactcttgacctcaaatgatctgcccgcctcagcatcccgaagtgctgggattacaggcgtaagccaccacgcccagcctagaacctcatcttctgaccacaatacaataaaaccaggaagagatagaaacaaagaaaagccctcagccacttggaagtttctgaactttctcttaagcaacccagggatcaaagtgaagatcagacccaacatctggaacacccagaagctggaggtgacataaacaggctgccagggtcggttcaatcccatcaaagctgggtcacagcccatgggaaaccatgaactgagcattcaagccaataaagccagaaatagaataaaacaagcttcagaagaacagaagaggggccgtgcacagaaacaataaaaatcactcaacagaggctaaacacacaaaataaagccaaacataccttctcattaaagaagataaatcttaatgaggacaaggtagattctggcattaaaaaggataaatgtgacattatggactgaatgtgtcctccccaaatttattttttatttttattttgtagagacaaggtctctctgtgttgcctaggctggtctcaaactcctgggctcaggtgatcctcctgccttggcttcccaaagtgcttggactataggtgtgagccactccacccagcaatccccccaaattcctacattgaagccctaacttccagtgtggctgaatatggaggtgggcctctaagaaaggagttaaatgggcgcggtggcacacatctgtaatcctaacactgtgggaggctgaggcgggcagatcatctgaggtcaggagctcaagaccagcctgaccaacatagtgaaactctgtccctaaaaaatacaaaaattagccgggcgtggtggcgggcgcctgtaatcctagctacttgggacgctgaggcaggagaaatgcttgaacccaggaggcagaggttgcagtgagccgagattgtgccactgcactccagcctgggccacaagagcaaaactccgtctcaaaaaaaaaaaaaaaagaaaaaatgaggtcataagtgtggggtctgatcagacagaatgagcatccttgtaagaagagacaccaggctaggcacggtggctcactcatgtaatcccagggctttgggaggctgaggtaagaggatcacttgaggccaggagttcaggaacagcctgggcaacatagcaggattctgtctctacaaaacaaaaacaaaaacaaaaccaaaacaaaaacagttggacacagtggtgcatgcctgcagtcccaggtacttggaggctccggcaagaggatcaatgagcccaggagtttgaggttttgcagtgaactgtgattgtgctgttgcactccagcctaggcaatagagaccctgtctcaaaaacaaaacagaacaccagagagctctctcctcacctctgttcccaccctcactgggcacaaaagtaaagccatgtggggacacagagaagatggccattacagtgagaaagagagtctttacgatgaaccaaattagctgggaccctgaccttggactcttggcctccagagctctgagaacaaacatttttgttgtttacccgccccctgccccatgcctgtggcactttgttacagcagcctaaataaaacaactaaaatatgtgagatgatggcaaggtgggcagaaggaaagttcaggaactatggacacaagactgtgggccctatgctacggtcaaagccaacgggttctctgaatacccaaaagctggttctctctctggctgcattctacaatcaccttaggagcttcaaacaacaccaattcctacgtgccctccagactgaatgatcagaacctgaaggtacagcccaggcaccggcactttaaaagagctccccagaagattctaatgtttagcgagaattgacagtactgtcccagtgggtcaatatctccctagcttaagacataccaggcgggatgtggtggctcacgcctgtaatcccagtgctttgggagaccaaggtgggcggatcacttcaggccaggagttcaagaccagcctggccaacatgatgaaaccctgtctcgactaaaagtacaggctgggtgcggtggttcacgccagtaatcccagcactttggaaggccgaagcgggcagatcacctgaggtcagatgtttgtgaccagcctggccaacatggcgaaaccccgtctctactaaaaatacaaaaaacaattagccgggcgtggtggtgggcgcctacactcccagctactcaggaggctgaggcaggagaatggcgtgaacccaggaggcggtgcttgcagcgagccgatatcgcgccatggcactccagcttgggcaacagagcgagactccgtctcaaaaaaaaaacaaaaaacaaaaaacaaactagccgcgtgtggtggcgcgtgcctgtaattccagctgctggagagggtgaggcatgagaattccttgaacctgggaggcagaggctgcagtgagctgagatcgtgccactgcactctaacctgggcgacagagcaagactccatctcaaatgaaaagaaaaaaaaaaaaagaaaaaagacataccagtgttttattcaaatacatgaaaaattcggccagacacggtggctcacacctgtaatcccagcattttgggaagccgaggtgggtggatcatttgaggtcaggagtttgagaccagcctgaccaacacagtgaaaccctgtctctactaaaaatacaaaaaaagggctgggagcagtggctcttgcctgtaatcccagcactcaaaacaaaaacaaaaacaaaaacaaaaacaaaaacaaaaacaaaaaaattagcctggagtggtggtgggcacctgtaactccagctatgcaggaggctgaggaaggagaacaggagaattgctggaacctatgaggtggagggtgcagtgagccgagatcgcaccactcactccagcctgggtgacagagtgagactctgcctcaataaaaagaaaaaagaaaaaaagaaaaaaaaaccatgaaaaattcaatgaaaaccagaacctacaaaaacatgtctggtataactactcctattgaggactatactagaggccacagccagtgcaataacataagaaaaaaataaaaggtacagtgacagaaaaggtttggcatgaaatgtaggtctgttaaacaaaataagaaaaggaacaagtgaagttgtacttgcagatgacatgacatttctatgtagaaaaacaaataagtgagtttattagcaaggtttcagaaggcaaattcaatacacaaaaatcgcctgtatttctatatactagcaatagacaacaggaaattgagaccatcctggctaacatggtgaaactctgtctctactaaaaatacaaaaaattagccgggcatggtggcgggtgcctgtagtcccagctactcaagaggctgaggcaggagaatggtgtgaacccaggaggcagagcttgcagtgagcggagatcgcaccactgcaccccagcctgggtgacagagagagactctgtctcaaaataataataataataacaacaatataatttacagctgggtgtggtggctcacgcctgtaatcccaacactgggaggccgaggtgggtggggatcacctgaggtcaggagtttgtgactagcctgaccaacatggtgaaaccctgtctctactaaatataaaaaattaggcaggcatggtagcacatgcctgtaatcccagctatttgggaggctgaggcaggagaatcacttgaacctgagaggtggaggttgcagtaagccgagattgcactgcagccttggtaacaagagtgagatttcatcttataaaaaaaaaaaaaatatatatatatatatatatacacacacacacacatatattattaaaaatatatatcttattaaaatatatatacatatatatgatctataatagcattaaaaatataaaatatgtggggatatatttggcaaaagacatgtcagaactgcacactgaaaactacaaaatattgctgacagagatgaaaggaaacctaaataaatggagagacataccatgttcatggattggaggactcaatattgagatcttagttctcatcaaattgatctgcaaatgttacccaaacacaaccatcaaaagccaagcaggcttctctaaaggaaaggacaagctgataaaattcacatgaaaatgtaaagtatctagaccagctgaaaaaactttgaacaagaacaaacgcgaagggctaagttcatgacttgttgaaaaactacgggaaccagacagcgtggcagcatcaagacggacatacacatcaaggaaacaggacggccagcccaaaggtagacgccacagaccctcacacacatgcagtccatgaatttttgacaggtgctgaggtgattcaacatgaggaggatcatcttttcacctaatagttctgaacaactggacagccacgtctaaaagaacgaagcccaaccacttcctcatactacatacaaatattaactcagaatggattatagacctaaatgtgaggactaaaactatgaaactttttagaagaaagcactggaaatttttttttttttgtctttttgtgagacaggatctcccactgttgcccaggctggagtacagtggtgtgatctcagctcactgcagcctcaaccttccaggctcaagcaatcctcccacttcagcctcccaagtagctgggattacaggcatgcaccaccacacctggaaatttttttttttttttggtggagatggggtctccctatgttgcacaggctggtttcaaactcctggtctcaagtgatcctcccaccttggccttccaaagtgttgggattacaggcgtgagccacctcacccagctggaaaaagtcttagtggtgtttaaaatcttttatacttaatggaaccctgaattttttttttttttcctgttttaggcagggtcttactctgtccccaggctggagtacagtgatgtaatcatggttcactgtagcctctacctactgtgctcagacaatcttcccacctcagcctcctgagtaccagggactacaagcatgcaccaccatgcctgactaatttttgtatttttttgtagagatgaggttttgccatgttgcccaggctgacctcgaactcctgggctcaagcaatctctctgcctcagcatcataatgtgcttggattacaggcatgagccactgtgcctagccaaaacactgttaagaaaattaaaatacagttgggtgtggtggcttgtgcctgtaatcccagcactttgggaggccgaggcgggaggatcgcttgagtccaggagttcaagaccagttctgtgtcttgctagtggttatataattaatttaagaggtaacactgcatagagccatacacacatgtaaaactggtgaaacctgaataaggtctatagtttagttagcagtatttcaattccctggttttgatattgtactatggaggtgtatggaggtgtaagatgttaacacaagggccgggcatggtggctcatgcctgtaatcccagcactttcggaggccaaggcgggcggatcacctgaggtcaggagtttgagaccagcctgaccaacatgcagaaaccgcgtttctactaaaaatacaaaaaatcagcccggcgtggtggcgcatgcctgtaatcccagccactcgggaggctgaggcaggagaatcacttgaacctgggagggggaggttgcggtgagctgagatcacgccattgcactccagcctgggcaacaagagccaaactccatctcaaaaaaaaaaaaaaaaagatgttaacacagagggagctggtgaagggcacaggggtctctctgtactatttttacaacttcctatgaattagtctatgattattttttttttccccagacgaagtctcgctcttgtcccccatgttggagtgcaatggcgcaatcttggctcactgcaacatctgcctccagggttcaagcaattctcctgcctcagcctcctgagtagctgggattacaggtgcccgccgccacacccggctaatttttgtattttaagtagagatggggtttcaccatgttgaccaggttggtcctcaaactcctgacctcaggtgatccgcccgcctcggcctcccaaagtgctgggattacaggtgtgagccaccgcacccagccaattatttcaaaataaacagttaataaaggtcagacacagtggctcacacttgtaatcccagcactttgggaggccgaagcaggggaatcacctgaagccaggaattggagaccagcctgggcaacacagcaagaccccgtctctacaaaaacattaataaaaaataaacaaatcaaaatcacaaaatgttaaaaaaaatgtattattactgctacattacctagaagctctattttgtgtgtgtgtgtgtgtgtgtgtgtgtgtgtgtgtgtgtgtgtgtgtgtgtgtgagagagagagagaaatagagatattgagagactgagaggtagggtcttgctctgtcacctaagctggagtgcagtggtgcaattacagcttactgcagcctcaatctcccaggcttaagggatcctcccatgtagctgagactacaggcatgagccactatgtccagctaatttttaaattttttgtagagacagggtctcgctaccttgaacgggctgaccttgaactcctgggctctggtggccctcctgtgttgacctcccaaagcattgggattacaggcatgagccactgcacccagcctagaagctctgttcatatttatttgcgaagatcaatttgatgactaagcagtaaactaatttataaaataatattaaatattaaaaccaactttaaacaattatcttcacctatgtatgtgtgtgtgtgtatatatatacacacacacacacacatatatatatatttaacaagtatctccaataccacaaccagtgtattttttgtttttttgagatggagcttcgctgatgttgtccaggctggagtgcagtggcgcgatctcggctcaccgcaaactctgcctcccaggttcaagcaattctcctgcctcagcttcccaagtagctgggactacaggtgtgcgccaccacgcccagctaattttgtatttttagtggagacctgcctcttaattctccaacatggaggggtttctccatgttggtcaggctggtctcaaactctcaacctcagatgatccgcccgccttggcctcccaaagtgctgggattgcaggcgtcgccaccgcgcacggccaccattatgcctcggcctcccacagtgctgggattacgggcgtggccactgcgcgcggccaccattgtgcctcggcctcccacagtgctgggattgcaggcgtggccaccgtgcgcggtcaccactgtattttttgacaagggtgagtcaggactgacacttaattcatttgtttgatatattaactgctttaaaaggacacacaatgctagctgcaccaaagtgcattcaaattcctcatagcatgaatctaattttaaaaaacctttgtagggcgggcatggtggctcacgactgtaatcccagcattttgggaggccgaggcgggcagatcacgacatcaggagttcaacaccagcctggccaagatggtgaaactccgtctctactaaaaatacaaaaaaaattagctgggcgcggtggcaggcgcctgtcatcccagctactcaggaggccgaggcaggagaatcgcttgaacccaggcggcagaggttgcagtgagctgagatcacgccactgccctccagcctgggggacagagtgagactccgcctcaaagaaaaaaaaaaaatcctctgtattaggaagttttattagaaaaaaatactagagcacaataagaaaatattcataacgaacttatacaaagtagcaaggaaaacattaagatgccaataaataaatgtgcaaagaacatgaacaaaagtcacacacacacaaatacaaacataatacacgagttcgttcccatgtaagaactcaatcaatatttgttgcaagactaaatgaaaaaggaaaatttatttagtgacagaaatggggaaacattcaacctcaaccctgagtgggaaaaaacttactgcccactaaattacccatctcatctcaccccggtaaataatgcccagtgctggcatgcacactggcagtatacaaactgagaaagactttctggaaagtgctacagccatgtgaccacagggcttcaccctgtgacctcattaaacctaagcagattacaggtctgaagggggctttctttagatgtggctccacctacttaggggcagatgaagaaaacaggggtctgggcagttctgaatgggaaggccaggcatcacctccctcttcagttgcacaaagtgtgcgtggcatcctcacatcccatctgcctcaatttcgctttttctctgaacacttttcaccatctgtctgaagcacacacacacattttattcacttccccattcccatgcatgaatgctaggacctttgcaattgtgggccaggaaagattgcaaatgataagccaccagcacagagagtagaaatgaaatcctggggttacaagctaaagcattactgacacccacttgtccagaacggctgaagctgggcggtgactgtcaacaggtatatacggactagaaagtggagctgctggaggaggccctgtaccttcctgccatgacacagcctccccccaagtgctgggcttgtgtgctcaacactccctcttgctgtcatcctaccacacctgcagactggaggtaatccagatgcaaggccgtcgagtcccgcaaacacccacctgcctcttaattttccaagtgagacctacatttcctcaagcgtgaagctcaataaaatcaactattgttttccgttttcatcacgagcgccactttccccctatttgttcaccgcctccactccacaagaactgctcttgacttggccaactttctgggacaccctcactacaaggatttatgagtcaaacaggtttttgtgctagcctggaaatctaactgctgacagcagttgtttcaagaagaaaatgctgttttggaaccaaacagcaggctgccaactgaaacaacataaacccacctccaagttcaaatgaaacaaacaaacaaaaagactggtccaagtgaggcaagctgtggtggctcacacctgtaatcccagcactttgggaggccaaggtgggctgatcacgaggtcaggagttcgagacaagcctggccaacacagtgaaacccgtctctactaaaaatacaaaaattagctgagcgtggtggtgggcgcctgtaatcccagctactcaggaggctgaggcaggaaaatcacttgaacccgggaggtggaggttgcagtgagccgagattgtgccactgcactccagcctgggcaacagagctagactctgtcttaaaaaaaaaaaaaaaaaaaaaagactggtcaaagtggcttacgtctgtaagatcagcactttgggaagtggaggcaggaggatctcttgaggccaggaggttgagactagcctggacaacacagtgagactctatctctacaaaaaattttataaatcagctaggtgtggtggtgcaggcctgtaatcccagctactcaggaggctgaggtgggaggatcaattgagcccaggaatttgaggttacagtgagctataatcatgccaccataaacacgcctggaggacagagtgaggccctgtttctaacatacacacacatatacacacagaaacatctcgagaggacacctccaaatgatgaagctattttgttgggtactgcggtggcacctgtgattcctcaagtagcttggaatcagcgtgctaacaccataaagtggctgcaaaagtcccagtgaagtcactgctgagagcaaacaggccttacagagaagttccaaggggacaggaaatttccagaggcttgagaggacaatgttcaggggaataagtacttgaagggaattatctaacaaggtgttaaagtaactagcttcttagacaagatgacatcaggaggaaaaaaaaacttattaaggcaaacatgtcagtttcaggccaactaaggctgtcagagagacatggaacacaagaagagaagagttttgaaatgtattcccatcaagagccaagaataatgaacttttgaatgtaaaacttagtgtgttccaaaacaagaaaggaaaaataacttgttactcggaatcgaagccaaaaggaatctcattgcttggggaggagggatgggagggtgggggtggtccttggcctgggaaggaaaactccaccaggccttcggagctgggcacgccctgttcccacaattaagaaaaaaaacgacgacctagagctcaaggccggtgctgacatctgacctactggatggcagccgcctgtaggaacatcaccatagactattggaattttctggcaagtactgggcactaaatcagagatgtgtttttagagaattccatgccaatactgctgtatagaatcttttattcatactttcccactaggtttgggcccctctaagctttcacgagtcaaagacccctcctgcttgctgaaaccacccacggaaggccggacaccgaggacctggccgcccaagcagaggcgactgacaagcgcggtccgggctggacggccccaccttccccgcccgggagagccaggccggacagcggcctccctcagacccgtccccaaggccgagcctcgccctgggccgtgctggtgccccattcgggacggagcggtggcccgtcagcacttccacggcctcctcagcaggccagatgggcagggccggcctggtgtctccccgcctggccgcgcgctcgcgggcagcgatgaccccaggcagcgggcgaccccaggcggacggcaggccgggtctgctcactcaccgttcgctgccgcgggcgcctgcgggggcgtctacatgccggaccgagcccgcaggccccgccgccgcgccgccgccagccgtcgctacctggcccttggcgccctggccgcctgttgccccatggccgcccggaccccggcgccggcgccgccgagcagcaatgcgccgcgcccgcccactgcgcaggcgcacccgccacgcatgcgcgctgccgcgcacgtggggcgtcccgcgcgtctgccgggtcccaccggcgccgggacaccccgcgcgggcgggaggcggcgggcgtggcgggaaagaggcgggcggtggggaagaggggcgaatcgcggtggagagcagtgaccagggagtggaggcgggcagcggggacaggggcgggcgtccgcgactcgggtaggcgggggtcggcgccccgaggagggcggcccccggctcccgtccccactcacctgccgcgtccggagggcgcccccgggtccgcccgccacgtctacgcctaggcgcccccgacattgtgatcccagcccggcgtcccgcccccaactcaccgccaccgcgggcgggacctcccggaccacgtgggccggctcaggggagtgcaggtgccccgcgagagctggccccgcccgccgccgcttccctaattaccgggctgtgacacggtgtgggccgagccggatttgggaaccgaaacttagagcagctgcggcagcgctgcgctccctcggggctgtccgtcggggctgggagggcggccctgcgcctgggggaaccgcgatcggcctcacgcccacctctagcggccaggtgcgccttgcacgcccacgaacgtcctcagaggtctacgcttgggatcccaaggctggcagtggagggaggacccggtggcctggggcacctctagggggaccagggagccgtgttttgcgcaccccacaggctggaggactcggggagttgggggaggaggccaaagccacaggagcggactttgtagtgtttgttggaactgcgggtcccacccagcccgcacttgctgaactggtggctgctcatcagcgccttcaggcctcaaatatcccaataatgtgccctatacccagttctcagctctcgagtcactgtcaggtaaactggcaatgcacgaccagctgctctaacctgctggtcccccaggtgccagacattgttttgtttttctgagatagtgtctcattcgtcccccaggccggagtccagtggcgggctcacggctcactgcagccttgacctctcaggtgcaagcgatccttccacttcagcttccctagtagttgggactacaagtaggtcccgccacactcgactacttcattcatatatatatatatttgtgtgtgtgtgtgtgtgtgtgtgtagagatgaggttttaccattttgcccaggctgggtctcaaacttcacccgcctcggcctcccaaagtactaggattataggcgtaagccactgcacctggcccagccattgttttctgaggttcagtccctgtctatactttctgtgtgatcacctggcccagggtcggtgtggacctgagtcctctgcagcccttccccacacccgcatacctgctctctggtcaggactcctgggacttgaatccagagacacggaacacggcctggccaagtcttcctgaaaaacacagctcttcagttcaggaccacagtgaagtacagggcaccaagggtgactggaaagggaagcaaggatcatgagaacttgggggatttcttaagctctgtaacttctcccggggttattttgcaaacccaactgtttcaaagtgaccaccagccacacccacagaagcggccttgagctgcccagttctttttctttggcggggggagagggggcggataagatcattaacataataatgcgtgagctgagtttttgcatatgatcattagcataataatgcttgatctagatggcgcacccacaagccaggcactgagccaggcctcagtagaatcttctagagtggaggcagtcaactgcttctgcagaggcaaccagtgactgtcgtgggccccaggtcacacagcaggtgcccttcgcgtgtcccgctgtgtagggagctccagcagctgccccgtctgtggcatgaaaaccctttgtctaccctgggcctgggcactgcctgcaggagagcttccctgtttcagagatgagaaaacaaaaccagggctgtggtttccttcagctgacaggttgtgcaatttctcagggcaggccccggatatgaccttgaagattcaggggccaagatctcacacccacacctcaccccaggcctggccagcaataactaagaccaaagctgggaaggctccttagggcacccagaatggtccaagaggcagctttgcttgggctgagaccaaagggaagagatgttcccgcagcaggaacagaagggtccagggctatcatgggggcttctgccagatggtgcacaggaagaggctctgccttcaagggattgggggtcaggaaaggccccctcctgcctgaccaggccccagggatggggcagcagtgggtggcatcccctgccctgaccttcctcagccccagggctgccattgctcaaggtggcagtggactcttcacataatttcgcattgttttttgtattctttaaggatggctcccatgttgtttacttcagaacccccaaaacctggacccatcctcttctgggggtcagcagggatggggagggtggagggagaagggggaacggaggccatgagggatggagcaggatggggtgcactggggtacaggttgctcctggggaggctgaggagagagggaagttggcttcaggtggcctggctccagtaaactgggtgaacgaagtctgcccagaacccacaagggtaagtggcctggagcctggggaaaggatgactgggaaggactgaggctcccagtgaaggacatcagtatggcaggctatctggtcatctcatccagcctccagccagcacccggcacaggccctgcccaggctgaaagccaggataggggcgtctgcaggggccagtgtctggatctgctcacatgacagtcttctgtttggcctggtttggggcgaggggcaacctctttcccaggatgccagccatgtgcagggcatactgaggattcaacagtggaaaccaaagtccatcaggtgttcaccttctagtggggcagacgggcaagaagcagaattggtgggggcaggcaggggttggggtacagttttgaccaaggtacccagggacaagtgtttctctctcaggcagaggcagcagcaaggaccaggaccctgaagtggtgagagcctagagtgggcggggatcatcaacagtaaccacctggcaggactgggactccctgtgtcctcacaagatccttaccaagcagcctagtataagacgaagtctcgctctgtagctcaggctggagtgtagtggcatgatctcagctcactgcaagctccgcctcccgggttcaagccattctcctgcctcagcctccagagctggagttacaggcgcacaccactgaacccggctcattttttgtatttttagcagagacggggtttcatcatgttggccaggctggtcttgaactcctgatctcaggtaatccatccacctcggcctcccaaagtgctgggattacaggcgtgagccacagcgcccggccacagcctggtacgtttattgtccacatttttcacgcgggggccagaggcacagagaggccaagtaacttgctcaaggtcacccagcgaggaaagggagctggggggtgggggtaggggacagggcgaggccagagagtagtgggaggggccgaggcggcctttcccgggagcgctcggttcccggccggcccttctattggccccagtcactcaggctcccaggtccggctcgggggggagcggggggccgcgccaggccgctgaagtgtccccgtttcgcgtgggcagagcgcgcctccccacgcatcctgctgagggccagcctctgctaggtgcgtgacacggaggggacagaacggaaaccttgtcctgctcaagtgtggacgtgcgtgccacgtgctagagtaaaattgaggtggggaacctccatccctgggacatggagcacaggggcgaccccgcgccgcttggtcaaaggaggtccgaggccctgcaggaacagcccacagccggagcgagctgcaggtcactccactgcctgtgtccacctgcgacaggtgcgcccgcgcaagcggggcggagccaggtgacccggacacaggaagcgcgccaggggcccccacaccgcggagctgctggcgacaaagggcgctgctcctgcataggccaggctaatgcaatctacaaactagatttctgtgcctacagtttgaaaatgattgcagttcactcagccagtgtggaattatcctcctctttccacactgccttagtcagtgccgctgtccaagtgcacgttgttggcgcccgttttcatttcctgttttgctaagaaagtggggcagtggcctccatgcccgccaagggacaggcaggccgccccagggaggggtccccctcagctctggctcttccaggccaaagccaaggggaaggggcaccagagggtcccaggtcccacatgccagctccctcagtctgcggggtgccaggctaggacacagaagccaacaggaatccccaaagggaggaagtggagtcgggggtgtggcagccgtgctgagatgctcggcctttatttactctgggcagggaccaagataggccactgcaggccggcaccctgcctcccggctgctggagcccctccctcccaggaactgccagccaggaaagagcctcaggtactctctgcatttaatttttaattttttttttcttttgacgcctccaagacaagttcaactctctagtgattttaagtggggtttttgtaagacagctggcagggttagggcttgtgaagaacttgcatgtctatgaagaactgatttatttcagggaaaagtgggggatgacgaagccaggcgagcccaccccgttcagcctgccaatcacacccacttcagcagcctaaaacagcaccaggtcaccccaccagggagacaacgccatagtgtcacttgcagtgctggcagatgggcacccttggtggcgtcagaaacacacccagcaccttgcctggagcagggcggctgggccctgctccgtgaatcccaagtgccctatgggagcctctccggccagggactgccagcctagaggaggggctgctgggttctctggtgcccaggggaggagggggcctacaggtactttctgctgagagccttcttcacttactaggaaaaagtttggctgggtgcggtggctcggcctgtaatcccagcactttgggaggctgaggagggcggatgacaaggtcaggagatggagaccatcctggctaagatggtgaaaccccgtctctactaaaaatacaaaaattagccgggtgtggtggtgggcacctgtagacccagctactcggaaggttgagccaggagaatggcgtgaacccaggaggcagagcttgcagtgagccgagatcgcgccactgcactccagcctgggcaagagcgagactccatctcaaaaaacaacaacaaattagccgggcatctgggccaggcgcggtggctcacacctgtaaccccagcactttgggaggctgatgtgggtggatcacaaggtcaggagatcgagaccatcctggcaaacatggtgaaaccctgtctctactaaaaatacaaaaaattagctgggcatggtagcaggcgcctgtaatcccagctacttaggaggctgaggcaggagaatcgcttgaacctgggaggtggaggttgcagtgagctgagatcgcaccattgcactccagcctgggcaaaaaagagcgaaactccgtctcaaaaaaaaaaaaaaaaaaaaattagcggggcgtcgtggtacgtgcctgtaatcccagctacttgggaggctgaggcaggagaatcacttgaacccagaaggcagaagttgcagtgagctgagatagcgccactgcactccagcctgggccacagagcgagactccacatcaagggagaaaaaaaaaaaaagttccagctgctggagccatgggaattaaaaaattactttttttttttttttgagaggcagtcttgctctctcacccaggctggagtgcagtggtgcgatcttggctcactgcaaactccgccttcccgggttcatgccattctcctgcctcagcctccagagtagctgtgattacaggcgtgtgccaccatgcccagctaattttgtattgcctatttaagattttaaaaaatcaccagtttggaaagcagggaagtggatggttctggagcctaggagcggctatttgggacacacacagccatggttttccacactaccatggccagtgctcatttttttcttactagatgcagttctttatattcagaccaagaggaacactcagttcagtcccaaggaaagctagtctctggagtaacatcctcagacattctaagggagggaaatggcagaggagaaaggcaaggcagccgcctgtggagactcccacggtgctgtgggcaaggcctatgcctggggaggggtctgggcgatggcaggtggacctccctgctctgctggcctgtgaggtggagcttcccaggaacccctccgaggagccaatgcgccactcatggattctgtgacgtggtggcggccatggcaccgcctggcatgagcaggcccgtcagacctcacagcaacagggacagcttagggaagcgggcgcgttgcaaactggaagtggacccgtaaataatcaccacaccaaagtccctcatgtcaaactgctttattacatcttaaataacagtacagtttaatatagtatctatcttgcatccagcttccttgcagtacactgactttaaaattaaatacaaaaggtggaaaggggtaagggtgcagagagctctacagagttgttggacggaaagagaaagaaggggtttcatttgtattctctttgccagatccaggcctaccgcaaggtcacagcacagttttgtatagaatgttgcagaaaacaggatggagaagccactactgctgctatgaaggagtgcggggggcggggcggggggtcccacagaacctgctttccaaacgctgctgctgaacactggccttgaaatgaacaccaggacaatctgtgtgtgatgggaatgagccacctcagatgtggagggccctgaagaatccatataggagggcaggctcttcactccctctccctccctctctctccctccccaccctcagaatccaacagcagtcgtttgcaacagaacttttttttttttaaagaaataaagaaaacagtgacttatcccgctacccaagcgtgtagagccgcgcgctgtactgcttccgatatgtgccacagagcagcaacgagaagtggacagagccgcaatggttacaactgtaagaggttatttcttaaaagaaaaagaacacctaaggactgagtcccatatgcacttttgagcatttctacagcatgcgattctaagagtaaacccacccaatatggcaaacaatcaaaatttttaaaatttaacttagaaagtctgagatcattattttcaaaacattgatttgtacattgtttcatacacaaataattgactgactatccaagcacaggacaggcatctctcttgaaaacagaggttcctcctagttgggggtggggtagtgttaggctattataaacttccctccaacttcacaaggaaacccaaagtgagattaaaaactcaactgagaagatagacaggatgggtcaggaggaacatggtgctggatctgagctcacttttcagcaaaggtgaaggattctctgatcacgcatttgagaccgtccccgcatgtgcttggccccatggcttctgaacatgttcttttctatgccacgtttgtgtgcaacaatgatctgtgacatcagacagaaaattaaaaaccagggactgaatttacacattgacaacatcagagaggctgccctagactctctggttttgattaactgttgaacacaaaggaatacattttaaaaaggaaatatgaatgcttccaaaatcttgctacaaacatgactgaaatttggacacgatgaccagatgaacaaagccctcagcatgttttgcatgaatgccacaaaacagggtcactggtctaaaattcaaatacactggtggaaaagtgtgtctgtctgacaattacactcaagtttaccttctggttaacatttttattatatatttccttttaaaattcattcaagacaaaaaagaaaacaaagacgatggccccggaaggaatgcacaatttgttttagtttacagcacagagatctttctctcaatgggaattgtgctcttggtttcagcaataagtgaaggaaaaaagatcttgcccttttgaagttctgaggggaggtgtagggtgtccacgttagtacggttggataggatatgctctcatggtaacgcgtccaagttggaatggtcttccagtctccatggcatccacatgctgttttaaacagagtttaaagaaatgtgaaaagaggcagagaatctaagtgcagacgcacagccaggtcactgctcttcccatcactgcatgagtgtctgcagctgagggcacgtgacttcagctttctgtaaacgtttcccacaacacaattccaaatcaatgctacatcaacatttatctagaaaccgttaatgacaacttcaaatgttctatgagaaacacgcacagttctcctcagagaagggcatttgggctgctgcattacctactggcgttagttccagatcttgaggaagctatcccaggaccctgtcgccacagccatgccatcgtcagtcacgcccaggcagctgacgcggttgtcatgcccagccaagacacctgggagcaaacaacagcagaatcacaccaaagcccagaggcatcgatctcacctgtgtgccatgttgtgacgaggacggatggtgcatctctcatgggacaagacccagagtctcccacggccaggaagggagggaaagttgcatccacgtggggaattaacctgcagcatatggccagccttgttaaaattcaaagacacgcacacacacgcaatcgataaatccagagcccctggcattgacttctcagcactcacttataaaacttaaaaaaagaagcaaaggccactatcaaaaaaatcaaaactatcatcagacgcagtggcttaggcctgtaatcccagcacgttggaaggccgaggcaggcagatcatgaggtcaggactttgagaccagcctggccaatatggtgaaaccccatttctactaaaaatacaaaaaccagcagggcgtggtggtgcgggccgtagtcccagctactcaggaggctagggtaggagaatcattggaacccaggaggtggagcttgcagtgagccaagatcgtgccagtgctctccagcctgggcgacagagcgagactccatctcaaaaaaaaaaaaaaaaaatcaaaaccgccccaatctcaaagcaatctgtaacacaggagcttagaggcatgagccgtttttcctttgtctgtgatccctagagcccagcacaaggcacagaacacaggagtagcgatggtggctgagaccactggcactgcactgtcactgtcatgtgatgagggggccttctgtcaacactcccaataaccttggcttggatcatcaccagccagaagctccacttcctcccagggggatccgaaggcccatttcagccaccctcctccacctcctgcagccaccacacagctgagtacaggggccggcgtgtgctctgccaaggcctgggctggcttccaccgcccttcaacagcactgtgactgtgagacttggctggaaatggctccactctggtccccccaggctggggagaaaaagaaatgtgtttaaccaggaggtgggagtggcacccatccggaagcaggaagccccggtaagggccaagacctggagccatgctcccttctgtcctcccaggtactgagacaaatgaatctaagtctgtaagtgtcaacagttctcaaattcaaatgcccaaatgaccatttttagtaaggaagtctcatcttttgtacacctggcaataacacgcttgcctttgatatgttaactgtaacggcacccagaggtgtccctgcatggaactcctccccctgaagcagagttcagaggggaaagcacggggctgggccctggagcctgcacagctgaccctctcctgcccactgactctccccagagccctccccgacgcatgtgggaagatctgctggtactcctcggagtccacttgcctggagggtcagagctgggccatcagtttgcgactgtcactcctgctacgccatgccacagtcccaccgatactaaaacactgcagcttatgcaaccactctgtgtttgctctaaagataccacgtaaatgtccacaagacacagaaaggccccatggccacgtacctgcccggtcggctttgagtgcatcccagacgttgcagttgaagtcgtcgtacccagcaaggaggaggcgcccgctcttggagaaggagacagaggtgatcccgcagatgatgttgtcatgggagtaagtcatgagctcctggtcagcacgaaggtcaaacagcctgcaggtggcgtcgtctgagccagtggcaaatgcattgccatttggaaagaactggaaagagaaagcaaatcaagacatcatgtaaacgctcagaaagaaacattgggaatatggattgctcaatggtagggctgcagagaacacagcaggcaaagaccagcaagactgtgctctggtaagaacagagggctgggccgggtgcggtggctcatgcctgtaatcccagcactttgggaggctgacgcgggtggatcacctgagatggggagtttgagaccagcctgaccaacatagagaaaccccatctatactaaaaatacaaaattagctgggcgtggcggcgtgcgcctgtaatcccagctactcaagaggctgaagcaggagaactgcttgaaaccgggaggcggcggaggctgcggtgagccaagattgcaccattgcaccccagcctgggcaacaagagcaaaactccgtctcaaaaaaaaaaaaaaaagggtggggggatgggggaggaactacaggggactgggatgggaggggatttgcactggggaggcacacaaacactgtgatcttggacactgtgattactgtccccaaagagtagaatttattccaaaggatagtgagaaagtagtcatcactgacaggtgtgcatgttgctgtagctgccagccatcagggctaatctcatggaggaaggagggaagcgggctgaccaaggctgtggtcaggactgcagcagagctctgtccaaccaacagatacatccttctaagtctcctcacaaggccaggggctggaaacactgcctagccatccgcgtgctaaagaggagggcaggttccctggttagctgtgcccctgaccagtaaggctctgtaaccactggtggcctgagttatcttactgtctttcccctccaggatcccaaccactgctcagctgtagaggtgggaacggggactggcatacaacaccctgtgagtatctgtgagacaagtggtcaacacagagaagtttcccatcgggagttttctgtatccccatctgtacatgaggttgtataaggatcagaaaggagaacatctaatccagaaaagtttaaaatttagcaatctgaacggctagcagagacggcagaggacccgaccccacacctccacccagactcacgcaaatggcattgatgtcagactcgtggccagtgaaggtctgccggcacatgccttctcgcacatcccagagtttggctgaagcatcacaagcaccagagacgaacagtctggtgtcaggagcaagagaaaggctcatgacatctccagtgtgtccggtaaacgtggtcgtctgctggccggtctcgatgtcccacagggcactggagcaggagcgaatgacaaggggacatcagccttaacttcttgggtggctagtcatgtgacagacaatctgtccttcaaaccacccagggccacagtgagcctctgcactgttactttaaaaacgtaaattgtttaaagacaaatttaaatgtaatacaactttggaagggaaacaaagcaaagcaagcaaaattatacagagatgagcacagggcctgggcttcagaatgacgggatcgctacctcaactcaaatgccagcaaacagggagctgggggcacttttcaagcagcaccactgaggctgtgccccctctttggtcatggatgggcatggaaggggtggcaggaagctacgtggaggccctggatggcggaggggacgcgactctatctgtggctgctccctctgtgccctcccttggcctcccctccacagggtctcagaaaaggcaggcaggagaaggccaatgccaggtaaacaaatggctcacagcaattctgaggtcctcctgccctttcctggaatcacaaacaggagagcagctgagttctcagtgatcacacctggtattttttttttttttttgagaccgaatttcactcttgttgcccaggctggagtgcaatggcgcgatcttggctcaccacaacctccgcctcccgagttcaagcgattctcctgcctcagcctctccagtagctgggattacaggcatgcgccaccatgcccggctaattttgtttgtatttttagtagagacggggtttctccatattggtcagactggtctcgaactcctgacctcaggtgatccgcccgcctcggcctcccaaagtgctgggattacaggcatgagccaccgcgcccggccatacctggtattctatcacatttctgcttaacaagctgtcaaaaggtgagacgctgacagagccctgcacagagcagaagcctggctcaggtgtaaggacagctgtgagggccacacgcccaccaacatactattctcctgtgcctcgacccatggaaggcaacaccagagagcactgtccgttcatgtcagcctcagaggaaagcctggctgggcctggcaatgcaaatccaatcagccaatctcaacagacactgcacagggagcctcctctctagggcctgagggactgactgcagaagggaagcaagatacgtaaaagagtctgaaaaaaatgattaatgaacagaagcactttaaaaatatcttctaataaataaagtcttctcaagattgacaatctaggtgacaaatcttttgtaaatctatgaaatttatacaacgaggacaccttataataccacagatgctttgctgacaagttggttaagggcccatgtctcggtgaaccccaccaactgcgtgactaggggtctgtgccctgggctgggcacagctcctgccaccaaatcatgcctcagaagaccagaaaaacccacatggccagctgaagtctaaaatgactctcataaaataactatctggacatttaatttagtactttgatgccacaaatgaaaaaattctagcatttaagtgggcttccgtttacctgtaaggtgaaaacactaaaaatgaagtctgatggaatcacttgaattgtgacgtctgttatttttagtctgtgctcattgttcacaatgacatgatgctatcagaaagggacaatcaaaacccaccctactcccacctatcatcacctaaggaggtacaaatatatagaggggaaaaaaaagaagagcaggtactttgagcctgattgtagttaaaatatctatgttggccaggcatgggggctcacacctgtaatcccagcactttcagaggctgacgcaggcagatcacgaggtcaacggataagagaccatcctggccaacgtggtgaaatcccgtctctactgaaaatacaaaaattagctgggtgtggtggcgcacacctgtagttcccagctactcgggaggctgagaggggagaattgcttgaatctgggaggcagaggttgcaatgagccgagatcacgccactccactctagcctggagacagagagagactctatctcaaaaaaaaaaaaaaaaagaaaaaaatgtgtattttagttctcagctgctgaaaattaaactttgtaaatttattagaagtataatgaggctaggcacggaggctcacgcctgtaatcccagcactttgggaggccgaggtgggcaggtcacctgaggtcaggagttcaggaccagcctggccaatgtggtgaaacctggtctctactaaaaatacaaaaattagtcaggcgtggtggcgggcacctgtaatcccagctattcaggaggatgaggcaggagaatcatttaaacccggcaggcagatgtcgcagagccaagattgagccattgtactccagcctgggtgacaagaacaaaactccatctcaaaaaaaaaaaaagtataatgaattcacacattgctactatgtgttttaaatcttaaggccacttaaattacagatggcctaatattatgtcaagaaccttatttcctccatgttcacagaggaatgtgccaggggctgtgggttctcaaggcactgcctgccccgggtcaggtacttaccacgtggtgtctccagagctggtgacgatctgattgtcatccaggaatcggcagcaggacaggtaacctggcaaagaacaggcctaagtgatgagctgaatccagcaggccttgcacccagcctcatacatagagaaacacattggcccggtggaagctctacgtctaaggtaagaccagcaccatgctagtgaccttttattcccatctgtgcacacagcagaaggtccacacgcactgctggtgagggtgagagcctggccaggcaggacagcacgtcccacagagacccacagctccgtgatgggggcagaagcagaaaccacacccatgaaacatacacatctttcatctgctttactgtttgacccatcaaaggctggggatccctcgtctatttactcattcagggcacgctgactccagtgcccaggaagcagccttaaccagacagacacctcctgctctcctacagcccacgctcagcagggacagagaatgagaatcactgaaagaggacatcagaaagggagtgctaggggaaggaagaggacaaagtaggggcctcacaagatggaagccaggagaggagggaggacgagagtagactcagagaaggaggatccaaacagagggcccagccagggcaggaggcggcgaggccacagggtcagggtggcaagggcctgcaggtcatggaagggataacgaaggcaacaggaacgcggcatggcagcaacactgcagacacgggggtgctcgtgaatatgtgtgggtgggtttgttttcttggggacagtggctgtgacacccacatcagcgtgggcacaattctgtgtctctgagtattcccacccactcccactgggaaggaagcatcagaggcgagagcaggacacaccaagatgccccgtcctaaacaacttccaaaatgaggaaaagcaacaacaaaaaatcagtccgcaatatccacacatgatgactggtctctactaaaaatacaaaaattaagcgtggtggcgggcacctgtaatcccagctactcaggagggtgaggcaggagaatcatttgaacccggcagttcaagttgttaatgacttctgttgaccattatttcttttgtacattgatcacagttctggtatttactgtggaactaaaagcatagggtcaacaaaccagttagtgtgtgcccaggattggtgacagactggccctaatctgaagattcaggggttccagtggcactggtgattcttgggatacctgtttagatttgagtgtttactgaaaagccttccccccaactacaccccagggagtcatgcgacactgcgtgaatcagcaaacaacaaaaataaaatgcaccaaaagaagaaacccactggggttttaatgtagaaagtgtaagattacagagaaaacaaagcatttatttaacaaacattattatcactattttttgagacagagtctcgtgctgtcgccaggctggagtgcagtgatgtgatctcggctcaccgcaacctccacctcccaggtcaagcgattctcctgcctcagcctcccaagtagctgggactacaggtgcacgccaccacacacagctaatttttgtatttttagtagagatggggtttcaccatgttggtcaggatggtcttgatctcttgaccttgtgatccacccacctcggcttcccaaagtgctaggattacaggcgtgagccaccatgcctggccaacaaacattattaaactggctctgacagaagaaaaatatgcatagatgacagagctcaaaatattaactacgtgcctacgaaagtatgcgtggtcaaatacttcctggaggccacaccacagggacactagggaccacaaaggtgaacccaagtccagctcagaggaggatagccctgcatacctggcgccccctgtagtgccctgcagcttgctgtcgtgccccgcagctcactgtcatgctcccgggtctccacccgagccctcctccactggcttcctggttcacactcacccttgcttcagggaagcacccccaccccgtcagatgcccatccagaccaggccaccgagccttgtagcacttagcctgtttgaatgtgagcacagaagggcaggaaagaagagtcatggagacctcagcacagcctgcatctcacacaggggaccaggcggaggcactcccaagtttactgcatgaaagaatcatgaccttggctggacgcggtggctcatgactgtaatcccagcacttggggaggctgaggtcaggagtttgagaccagcctggccaacatggtgaaaccccgtctctactaaaaatataaaaattagccagctgtggtggtgggtgctgggtctgtaatcccagctactcgagaggctgaggcaggagaatcgcttgaacccaggaggcagaggttgcagtgagccgagttcacagcggtgcactccagcctgggcaacagagtgagactctgcctcaaaaaaacaaaaaacatgacctcataggtctcaaagatgacctctctgtcccaccctgtgcaggctgtagtgaagctacacagaatccatcagcttcttactccaagaaccagagactgaaccctaaaatcacagctctcaagcgctgataaaatgatgtggacaagcatcagctgacaggaactatgaaggacaaggggaatgaccgaatgtataagccacacatggcccctgacttacaattttgtgactttatgatggtttgaaagacacacgcatttaataggaaaaccatgctccaagtacccatacaactattctgtgttttcattttcaggagtgtccaataatttacatgagatgttcaactttttcttataagatatgtattatgttagatggttctgcccaaccagaggccactctaagtgtctgtgcatgttcaggttggggggtgaggtgtgtccagtgcggctggagagcaggatgggtggtgcaatgcccagggtgcaagcatactccatgaggcccagtctgtgaacagagaccaggtctaaccccttcttccaggaaagcctcgtagggccttctggccaagaggccacgagtggtgaagactgcagactctgaaatcagaaatacctgggctccactgtcagcatggcagctgaggaagagtgaaaattcctctaagttcttttagaagtcccagcctccccatgtaactggggaactgatgggaggagcagagctgtctgtgcacataagaagttctcagtaaatggagacagttactatttctgttattattgaatttgaacaaattccctgggtatgtgtggggggacacttcaggtgaaaacacgcccctcctcccctggtgcgggggcctgtgctgccaccctctggaagcctgcagaggggcagggaaaacagaccctgaacaaaagtgtgcacccagtgaggaggtgcaagggcacaaaggtggcaccaagtgcctcaaggagaggctgaaacgcggcctggggacctcgcagtggtctggtcatataggcagtgggtgtgaagggctgtcctgtgtctcatagggaccactggctatagggacaaggctgttaaagtccaggagagagggggtggcttgaagagaggcacggcagagagtggaagcgtaggagaaagatgggctcctgggcatgtggtgtcagcagaggtgcctcaaggatagagtgagtccagagtctagaaaggagcagatcaccaggctctgggaagagcacagcatgggtgcacacactgctctacccagcatggctgccgacccaaagacagcaaagccaagaaggacacacaagcgtggccagatgcagccctgtgaggaaacttacccaagaacgggacgatgggcttgagaaaccatccatctacaaggatggcgtttgctgcagcaatgtttataataaattgtgggaaactgtgaactgcctaaatgtctcacaataggaacaaattagtgcaccacaccatgaaactctctacagctcctgagttacagaacgacagtataatactatagttatataatactgtataatactactgcataactattgtataatactgtatttctggatggaattatagggtctcccaacataaaagatgatgattcaaagttcctttccaaaattcctttttttttttgagatggagtctcgctctgccacccaggctggagtgcagtggtgcggcctctgctcactgcaacctccgccaccccggttcagcacttctcctgcttcagcctcccaagtagctgggactacaggcacctgccaccacatccagctaatttttgtatttttagtagagatggggttttgccatgttggcaggctggtcttgcactcctaacatcaggtgatccacctgcctcagcctcccaaagtgctgggattataggcatgagccaccgcgcccagccccctttccaaaatttctacaatgaacacactttgaaaggtttagttctcctacctgcaccctggagaacatccctgttgggagcaggggcaaggagaccccacccaagggaggcgcacaggacacactgaaaggcaggcgggcaaatgccaagaagtcagccatgaccacgcccagtccctcactagtcctcctccgacaggtggtttcaggagcacctgtgccgccccaggatcggctccaaggagcaaaaacaagaccgtgctggcgagggacaggctcagcctagacctggagggaaaggtgcccagccctgcaccgaggcatgcacttggagagcagaggtgttttcttcaagttcagtaagaaggaaaatgaaagagatgaggaagtaacttgaagatgtgaaagtgaggctcagagggttgcacagaggagtgcccgggcaccatgagtgcctccatgatggtgtgaggctgtgaggcccaccagtgcagccaagatactggggctggtaacagtgagcctcaagcagacatcccagtcaccagctgccctgttgtggctcctgaagcagggtttacggggagacaacatatatccccttctgtgtccaagcttgtgaggcctgtcagaaaaaaatccgctattttcatgaatatagaaaatgttctgcttctcactatatgaagacaccgtgcctaaaaatgccaagttttggccaccacagtgggctctgtcactgacagctgtgcacgctgtatcatgaaggccttaggctggacttctgatcaatgcttatgtatctgtagccatcttgatcagaatgatccaggcaagggccgccgtgtctccactgcccgagaggtatgcaaagaacaaagctctaagagcaagcgttgagtctccctgcattggcccttagggatctgctttgataaaaatctgagactggatcagagggctggaaataagctttttttggagacggagtttcgctcttgttgcccaggctggagtgtagtggagcgatctcagctcactgcaaccttgcctgctgggttcaagtgattctcctgcctcaggatc

SEQ ID NO: 566 - DNA, 2551 bp, Homo sapiens
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaaaaaaaaaaaaaaaaaa

SEQ ID NO: 567 - DNA, 1445 bp, Homo sapiens
tttttttttttgatgttctccagtgcctcagtggcagcagaactggccctgtatcaggccgctaccgccactccatgaccaacctccctgcatacccccccccccagcacccctcccacaggaccgcttctgtgtttgggacccaccaggcctttgcaccatacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcagtgcctccctccccagcggtccctcaagcagcccaggcgagcgtccctgccactgtgcccatgcagatgccaagccagcagagtcagcaggcgctcgctggagcgacccgaagccagagcagagcagagcaggtcataaaactacacggaagagctgaaagtgcccccagatgaggactgcatcatctgcatggagaagctgtccgcagcgtctggatacagcgatgtgactgacagcaaggcaatggggcccctggctgtgggctgcctcaccaagtgcagccacgccttccacctgctgtgcctcctggccatgtactgcaacggcaataagggccctgagcaccccaatcccggaaagccgttcactgccagagggtttcccgccagtgctaccttccagacaacgccagggccgcaagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagccacgtatctgcaacgcgcccctccctggccctggaccctatcgtacagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtctcggcgaaggttgggactcgactggtgtttgatcacgatgggaaaatcatccagaagaccccctacccccaccccagagggaccacagtcagcgtgaagcagttattttctacgctacctgtgcgccataaggaatttcaaaggaatattaagaagaaacatgctgcttccccttcgccttctgccgtgattgtcagttttaaccggaa

SEQ ID NO: 568 - DNA, 708 bp, Homo sapiens
ttttttttgtcccggcgctggcttttattgcctcctggcagaaaggaggtgtcccaggccaggccaggcaggaaagggctggggccaggggagtttcagtctatgtggtggaggctcaaatttggagctggaggggttggggcggttcttaaagctgaacttggggccaagggtccctgggtctgggctgggagactcagtcaaaaataggtattgcttatcctctgggactatgacagcccctccctggggttgggggtgtgacagggacagaagccgacccagggggtccctgaaagcccaggggcaggaggatgcctgggactgcatctgcctcctgcggggcctggacagggagggggccaaaccacagcggcccctcctccggtcattgtgcgggcctctgaggctgtggcaggtgcgcggtgctcacagctcatcgtggtgcccggtcaggtcctcgccatagttggtggcctgactgcccacaaacatgttccaattacccaggaatttcgctttgctcagccagccattcctgtccgtgtcgctctcgtgcagcaggtggggtgctttcaccagggggctgttcttggccaggggcaacacccagtgggccacctaacttccattcagatgcccattcttgttagaacccgaattaccggacttgctccttttcgtcttcacccagctggcttcacttcc

SEQ ID NO: 569 - DNA, 3227 bp, Homo sapiens
cacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttcccgagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaatcgatgagtagaggcaaaaatgccccttcatctttctctatatattttccagttgaaaacaaactaagaagtcctttaagactttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagggattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaggttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctaattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaa

SEQ ID NO: 570 - DNA, 1638 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 571 - DNA, 2112 bp, Homo sapiens
ataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacccggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacttatcaagatgcatttattaggaaggaggagtttagagagcaggctatcagaataaccactcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagttagagtcctcaagccaaatagctaaagctgttttatcacaacaaaggcctagtttgttccatgagtgtgcatttcatttcttcagttaaagccttcagagacacacaataaaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgagtgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgataactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatcttatcattcgtcttcttttccaaactacacatcactgtatgactcaaccagtagcagttatattgccccttggtttttattcagtttaactactgtttccaagataaatgagctaataagcttt

SEQ ID NO: 572 - DNA, 527 bp, Homo sapiens
ttttttgttttgttttatacttttatcaaactccccagcaaacttgctgactgcatttccacacattaccaacacctgccaggacttcacagcagggtgacccgctaagcaagctggcctaggttcagcccacactgctgctacctactcttcaagacattaggtgtgaacagagaaggggaatgaggtgacctgggtttgaatgacccagggcccaatgcacaagagagaattttgatgtcaaattagggtggcaaggagaaaacaaaaaagatccaacttagaaacagaaccatgattcaacatttgcaaaaagcatcatcaataagcctgaagaaggccacggactgtgcatccgctggctcagagaaaggctgggcagccggaacagcagcttcctgggtaaccaggcaacaatctcagcgcctgggagtcagggctgcgcactccactctggccagaacacaaacggcattggcactgtaagctctcagttacgtggccctcttttctctcctctatttctc

SEQ ID NO: 573 - DNA, 5758 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaa

SEQ ID NO: 574 - DNA, 166064 bp, Homo sapiens
aagctttgaaaaatggactgggcacaggaggcggaggttgcggtgagccaagatcgtgccattgtactccagcctgggtgacaaagagtgaaactccatcttaaaaataaaataagctttgaaaaatgactgcatttgataatctttaagtttcttccctagtctaaaaccctaggttttatcccaaaccagctagatcctgccttagataaaggtccaggaaggaggcctctttgttttgttttgttaacacataccctttccctctgaaaagcagcttaattctaggcatcgggcacgagaggactgggcttttggcgtgcccaggttgagcattagatatacaccaagaagcaaggacagaggagatgggcaggaagtctctttggaagaacagaccaaggttatgataaggagatgtttgcttggcctgcaggccagttgcaagagcgtggttttagcctgttatcttgccggacttgttgggaggatgataataagggtgaccatatggtgaatggaccctagggccaaccgccaagtgcagctgtagacatttattttctggttcaggatagagatgttttatccagggtattcagttgtgtgagcggttctcagcttgttctcccaattctgattgatggtgactcaccatgtctttgtaggcctgatttgacgttgctttatattttagagatatttctgaaaagctggagcaaagcacaccttttacagcaagatctcacttccagtgacttccatcattatttcagagatacatttgcagggaaaaaagtttcctccttgaaataagaaaagtcttaatctatacgtctgtttctggaactaagaaggctttgggtctttgattctgctcacacaactcttgtaataaaacctagtcaatcgcacctgttatcggaggccgaggcaggcggatcatctgaggtcaggagtttgagaccagcctcaccaacatagtgaaatcctgtctctactaaaaatacaaaacaattagccaggcatggtaccatgtgcctgtaatctcagctactcgggaggctaaggcacgagaatcacttgaacccaggaggcagaggttgcagtaagctgagatcacgccactgcactccagcctgggtgacaaagcaagactccgtctcaaaaaacaaacaaaacaaacaaaaatcctagtcaaatggactaaatgtgaatggaattagcaattagcaacttctttacacataggttggactcatttttcttgtagagtgttattcctagttatgtccagaagttattcttttttttttttttttttttgtgagacggagtctcgctctgttgcccaggctggagtgcagtggcgcgatcttggctcactgcaagctccgcctcccaggttcacgccattctcctgcctcagcttcccaagtagctgggactacaggcacccgccaccacgcccggctagttttctttgtattttcagtagagatggggtttcactgtgttagccaggatggtcttgatctcctgacctcgtgatctgcctgtctcggcctcccaaagttctgggattacaggcatgagccactgcgcccggctcagaagttattcttataattgtgggagagttattcctataagatttaaggatcttgctgggtaccgtggcccacattttgtaatcccagcacttcgggaggccaaggtaggatgactgcttaaggccaggaatttaagaccggtctgggcaacacagtgagaacccatctctgcaaaaacagaaaaaattagctgggcatagtggtacacgtctgtaatcccagctacttgggaggctgaggcaggaggattgttgacactgatggaggaggattgctggagcttaggagttcaagactgcagtaagctatgattgtaccactgcactccagcccgggtaacagagctagacccttatctctaaaaaaaaaacaaaaaaactcaaaaaaattaaaaaaaagatttaagcgtcttcggccccaagttcatgcttgtttgtatattctctcattggaccccagcttgtggggaaatttttagattattgcaaatcctccctgatttcatgagagcttggagtcccttggggctttatgtgatgatattgttcaaagagctcatcagggctcaggcatctggtatgcggtttaagagactacaagtttcaccagtttatttgcaactcatcatactcagctaccaatgctgaaagcagaacttctgagcaaatcttgcagcgaatttctatttgttcctttaacaaaaacccaagtcatcaactatttcacggtgacccatcacgtaaaagcacatttatttatttttgaagctcagcttccttgaagttttgttttgttgcctacaaaagatttagtacaaaatccatgaaaataacgcatcagtgtaggctacgggtattgctgccacaaaaatttatacagtccctaagtgtgaaaagagctaaatgaaaaatgcccagtctgaggttgaagtgcgtgtcttgaaggtattttgcaaatttcacgttgccaatgagtaaacttctcaggtaccaggttctggttatggatggaatgactgcatttaattgtccttagtggggccttttgagctgttctgttaagaaaaaaaaaaaaaagattctaattatatccttccttcctcgcttctgtaactgggaatcctccagagattcgagcctacctaattaagtttctctttggtgtggaacatgtggaatggcagtgatgtttattaggttgatgcaaaagtaatcacaccaaactagtatgtggatgatgccaaaaaaaaaaaaaaaaaaaaggagtgtttggggcaaagcttaggattcttcgctgtaggatgaccatgcctcctggtccgtacaccccagtatctgggcaggcaggatggcagtggtgcctccatccgtcccatctggctgtgattagaagcaggtctggcccacacaccagtcttctttctctggggtccctgccgctttgcccgacagtgaggtcataccttcggcacgaggcccggctggaattcgcctgggtttgtctgtgcaactcaagttgacacatgaggttttcattaggtggctcactgggagcgggggtgccttgccggctacacatggaacagtcatctccctggattagggatctcgcctggatttcctggacacggatccatccagacattcccaggggacagaatggaaggcaggcaggagggtctgggattgctcacctggcctggagccagtttgccctcagtggtgggactggctgtgtgtgtgtgtgtgtgtgtgtgtgtgtgtgtgtgtgcgcgccaaatgggctgaactgctcagagttattttattttattttattttttatagaggcagggtcttactgtgttacccaagctggagtgcagtagtatgcaatcattgatcagtgcagcctcaaaatcctggtttcaagctatcctcccacctcagcctcccaaatggctgggactacaggtgtgtgcaaccccacccagctaagtttttttattattctttgcagagatgaagtctcactctattacccaggttggtctcaagttcctggcctcaagggattctccagccttagcctcgctaagtggtgggattacagatgtgagccactgggcacagcctgaactattcagagttaaataaacaaaaagcccaaacttctgcccagtgcctggggtctcctccttggctcatcactgcaaaagttatttcttggaactttaactcagttctttgttctcttgtggtcactcttccatttctctttcatcagcctctgcagctaaagtgacttttaccaagcaccagttggggaccaagattcacctttcctggatgccttttttgggggccaggatccctccatcagccctgattctggaagcctgcagctcttttccaccaggctccttgagacctttaagcccaattcccaaggtgtcctttgcatgtcaggaatcgacttccatcccctgcatcgtattagttctgtatcatccttggattcgttgacaaaatagtcacttaaaggccgggcgtggtggctcacgcctgtaatcccagcactttgtgaggccgaggcgggtggatcacttgaggtcaggagtttgagaccggcctggccaatatggtgaaaccccatctctaataaaaatacaaaaattagctgggcatggtggcaggcacctgtaatcccagctgctcagcaggttgaggcaggagaattgcttgaacctgggagtcagaggttgcggtgagccgagattgtgccattgcactccagcctgggtgtcctagtgagactctgtctcaaaaaatatatatataaaagaaaaaaaaatagtcaaaaaattgtctccaaagctgtattctgtttaatttttttttttttttttgggtagacatagggggtctcactttgttgctcaggctgtcttgaacttctggcttcaagtgattctcccacctccgcttcccaaagtgctgggattacaggcttgagccaccacacccagccacagctgaattatagaagcaggttgagaagaatggcttcttgaagtcactgtgggctgtgctacaccctgtgtgttccccttagctctgtggtccccacagcagctgtttgggtgatctcagagcttcctgcatcattcactggggaataaaggcttgatatcctcaagacctaagggatgtatttgactgatttctgcattttcagtgttcttttttttacactttaagttctagggtacatgtgcacaacgtgcaggtttgttatgtatgtgtacacgtgccatgttggtgtgctgcacctattaattcgtcatttacattaggtatatctcctaatgctatccctcccctctccccccaccccacgacaggccccggtgtgtgatattccccttcctgtgtccaggtgttctcattgttcaattcccacctatgagtgagaacatacggtgtttgattttctgtcgttgtgatagtttgctgagaatgatggtttccagcttcatccatgtccctacgaaggatatgaactcatccttttttatggctgcatagtattccgtggtgtatgtgtgccacatgttcttaatccagtctatcattgatggacatttgggttggttccaggtctttgctattgtgaatagtgccacaataaacatatgtgtgcatgtgtctttatagcagcatgatttataatcctttgggtatatacccagtaatgggattgctgggtcaaatggtatttctggttctagatccttgaggaatcgccacactgtcttccacaatggttgaactagtttacagtcccaccatcagtgtaaaacttttcctgtttctccacaaccacactactaggtcatctggagtgaatccagctagctttgcaaatgctttcctgaaacagtcgaaccaggaagcgttcttggcagctcaggggccctcctcggtctcccaaagggctgggattacaggtgtgagccatcatgcccggccatgagcctgatcctttaacaatcacatcaggttattgtgcagcaatctgtccattgacacaattgggtgggggcggggggacccttggttaaaagaaaactctttggctacagagaagtcattgagcttgtggatatttgcaggagcaagaaggtctgagtggaagatacatgtgagatgatgaggagtttttcccttgaaaacctgatgaaggaagtaaagtctgtccttaggggttcagtcacccctgtctgaatgcaggtggccctcaaagtgcttgcatgtgcagagacctggtgtcctctctcctccatgtgtggtccagggacaggcagagtcagcatcacttggaagcatgtttaagatgctccaactcaggccctacccctgacttgctgaatcagaattttccttctatctatctatctatctttatctatctatctatctatctatctatctatctatctatctatctatcttttagagacaaggtctcgctctgttgcccaggctggaatgcagtggtgtcatcatagctcactgcagccttgccccctgggctcaagccatccgcctgcctcagcttcccgagttgctgggactacaggcatgcgtcgtcaccatgcctggctaatttttattttttattatttgtagcaatgaagttttgctatgttgcccaggctggtgtagaactcctggcctcaagcagtctcccaccttggcctcccaaagtgcttgggttactggcgtgagctaccaggcttggcccagaattttccttttaccaagattcccagatgtttcatatacacattgaagttggagataccctagtctgaggcacactttgacaaatggaaagcaaacccaattatgtttccttctttgagagtctctctagggagtgaagcccctccctagtctcctgcagggagctcagtgcctggagatttgtaagtttacaaacgatataattcacaaagccactagtgttggtgaagaacaactaaagaaaaatgtctctgcaaatgcctgcatttgtgaataagcataattagcattaaactcttttgtatttcactctgtgttagtgaattatggcttgtgtgcttttgatctttactgtggcaagttttaactgggtaattaatgataaataacacttgtgtaatgctcaccaggaccccaataataaccctggataacaataatactagctaatgcatgcagagttttcatcatgggccaaagactgttctaagcactttatttattaacttacttagtcctcacaaaagccataggtgctaactattatgattctcattttgtggatgagaaaaatgaagtaccgaggtttctagaaacttgcacaggtcatgccactagtaagagccatatgactctaagatcttaaccagatagcttttagatatagtattctttttgcaattttagtggatataggtcactgagggtgacaacaggacattgaaactctgaaaaacacacacacacgcccctgagtcataaataccttggtatttcaaacctatatgtgaatgttttggcttccaattgctttccaaaatagtctctagaaacatggggttctcatgaggttacctttggttgggcgaaagaccctagccactccccaaaatatccttgtatgagagcagaggatgtgaattgaagacagtctttaggtttctcattgttttggtgaagggagaattcttcagacttgcttgggacatggaatggtagtggatgatcatggcagttcctctccaacattcctatctccctaagcaagtctgtcttctacagtatgcccaggaaggtatgccatctccatcttattaacactgaccgtgttgaattcaagtttcagccaatgactaactagactatttgagtcccttctagctattcaagccaatatattaaaaaaaaattctgggccaggcatggtggctcacgcctgtaatcccagcactttgggaggctgaggcaggcagatcacctgaggtcaggagttcgagaccagcctgaccaacagggaaaaacctcatctctactaaaaatacagaattagctgggtgttgtggtgtgcgcctgtattcccagctactcgggaggtggcggcaggagaatcacttgaacccaggaggcagaggttgcagtgagctgagattgtgccattgcactcccacctgggcaacaagagttaaaaaaaaaattctggtatgtgcacctatttcaataagagcagcctcatccaatattacagtgtatcttctttgatttaacacctagagtccattgttacacctattccccagatgtaagctgattgcaattctctgttcattcacatcagacctagaatgtttcctcttgggatatgccaatctgattctagccatgggcttagagacaaacctggtaggggtagaccttgaagaaataggcatcccctatcaaggcaactgccttagttgtgtttattacaggccttcatggtcttcaagttgatcttgtctgagctgtaagagaggacgtaagggagactttgggaatcagttttctaaatccacctaaaaattcctgttctgaatctcaggtcccactccttttccatcaggacctgaaatttcacataagagatttgatgagtctgtgatttcaactgataattctacagagcacacagttaaatttggcatcttccctgcagggttataagaaataagtgattattttagaaccaccgcagaagcaatctagttctctgtgacttgagctgagagtttaaaggtctgagcttgtttgttcttacaagggtgttcagaagcagccatcccagctggcagtcctggtagtcatcatcgttaccataaaggtcaaaccttggagccacttaggtcttccaaagccttactttaaataattattgtatcccaagaaaccacagatgacagttaattaatcataatgctaatgcatgcagtagatactagtatccccttttcagtgggcaaggaggtcagcacttcatttaaggttagaggcaagcaaaccaatctcagaatcccacttgggaagtttgttttctccctggtacgagtgtacggtgccatcttcaatgcagaaaccgtgctggattcctagaagtgagattctatgtgaaatataggaaattgctaaaattcttcatgctaagtaacattttcttaggcagggtttaccaaaaggaatgtatgagaatgcctgtcttagaacattttgaccaatattaagtattataatttttaaaaatcataagtaacatgatggtgaaaagtggcaattcattttgctttaactagtatgtgagaggaagaattttttaaatatattgattggttacccatttttttcccctttgcaggctgcgtactttgttttcagagctgtttcagtaaggataggctaagttatgctgcagcaataaatatacccccaaatagcagtggcttaaaaccacaaaattaaagctgtcactcagactgtgtgtcatcgcgagttggttgggtcttttctctgtgacatcctcactcaagagttgtggcagaaagagactccagcccgtctctccttccatgttagctaaggcaggggaaagagacccggggaatcacacagtgattcttaagggttttgtcacttctattcacatttcactggctaaagcaagtcacatggccatgattattatcaaagggtgttgaggagtacaacccaactatatgcccagaagggaacaaagtagaaatacttggtgaacaacactaatgataactttagaattttaggcttctcctttttttttttttttttttttttttactagaatacaatattcattgcaaaagttttattgcagggcaagttcttagaagtaccatgaagaagggcgaaacacaattattatgggagactctacacattcctttccatttgatcaagtggataaagcaaagtaacagaatttgaatgacacggaatgtgtgtatatatgtgtgtgtgggtgtgtgtgtgtgttataaattttgtacccttaaaaagagaacagcttactttttaagtgattctggaacattaaataaaacatgactatgtattaggctacaaagacaacctaattaaatcgtaaagaacaagtaatataggcacattctttgactacaatacaataaacgagaaattaataacaaaagtttgaataagaatcccacccacttggaaatttaaaaattaaaaaccaaaaacctttcaatctcatgaacagatccaagcactgattctgtggaaaagaaaagcaacaaattcacaaagatagcatatttaattaagaaggaaagcattaccactaaaataaactagatatgaaaagtaaatatgggagatttttaaaaagaatacttgatacagtttcatattaatgcacttgaatatctacatgaaatggaaatttttctggaaaaatgtaaattattgaaattggttcaagctgaagtcaatagtctaaatcagaagttgcatacttgcagcctaccagccaaatacagctcatagccatgttatatttggccgtacaccattttataaagcagaaaatctcacattaaaaatatacatttctcctgttaaaatattggagaatttggcaagactagacctgcattccttcattgcaataatttggtggagttgagtggccatcccctctgggtacggcatctgccacagtctccactgttcattagtgttctatgcctgcctactgatggactggcttggtctctataggctttagagtttgcaaccctacctatacagaccagcaataagggaatattttaccattctattttcattcctcatttcccttaattatagggaattaatttttctagtttttaatttttattttttatggatataagttatacatatttatggggtacatgtgatattttgatacaagcatatgatgtgtgatgatcaaatcagggtgattgaggtatccatcgcctaaagtgctcacaatttctttgtgttaggaacatagcagttgcactcttttagttattttgaaatatacaataaattactggggtgtttgtttgtttgtctgtttgagacggagtctcactctgtcacccagactggagtgcaatggtgagatcttgactcactgctacctttgcctaccagttccagcgattctcctgcctcagcctcccaagtagctaggattacaggtgtgcaccaccaggcctggctaattttttttgtatttttagtagaaagggagtctcaccatgttggccagtctggcctcaaattccaaacctcaggtgatccgcccaccctctgcctcccaaaatgctgggattacaggcatgagccaccgcgccctgccagtaaattactgttaataataatcaccctattgtgctcctgaacactaggtctcattccttctcaataactgtatttttatacccattagccatctcttcttaccccacacccactacccatccttgcccctataatcatcgttctactctctttctccacgagttcaatattttttttaagctaccatagatcagtgagaacatgagatatttgtctttctgcacttggcttgtttcacttaacatagtgtcttccagttcaacccatgtggttgcaagtaaaaggatttccttccttttatggctaatattccactgtgtaaatgtgccacattttaaaaaatccattcatccattgatggacacttggatagatttcatatcttagctattgtgaataatgctgttgtaaacacgaaagtgcagataagggaattgatgtttttgtgggtttttgttgtgtatttgttaccatttctagctacttcaatagattacttatttaaattctttattatttaataattaaggcaactaggatgggaaattggacactgagaaaagtctcagtaatatctctcaaattttaatagacggttttgatgttttcattataatattttattgtatttttaaaattccctctgctacttcataaattttatagaaaaccatcttacaatttaatttccgagtcactgggatttttaagtttctagtttacattttacttttctcctttctttttcggatggagctctgtcacccaggctggagtgcagtggcgcgatctcagctcactgcaatctctgcctcccaggttcaagcaattctcctgcctcagcctcccaagtggctgggactacaggcatgcgccaccaggtctggctaatttttgtacttttttttagtagacatggggtttcaccatgttggccgggctagtctcgaactcctgacctccagcgatctgcccaccttggcctcccaaagtgctgggattacaggcgtgagccaattttctattttcattgcattatgcaaagtaagtataacctgatatttgctaagatttttctctgtaaccaagaataagatgaactttcatgaaggtactggctctatgctacaaggctttttgtatgtgcatagaagttatcttcacattacccatgtgccttgtagccctatttttggttgttttgtccaagataaattattgtgatgtattgatgttatgttacttcctggatttacttccaacagtttgtattttaattttcaatgctctgtcctcatagtggatttcaccttttatcagtgcaaatgttctttaaatgcttttgagtcctgttgatttttgccacataacctttttgcttgtgtttgcataacatttatctttatgcgcagtggtcactgggaccgttcacaattattcagtttcttttccttccaggaatacggtacacgatgccctacctttttctgtgattttgttaggggtgaaacttttacccaatatgtgtgattatgttgtcatttttaattattctgagagcccttttattggtacacttagccttttatatttatttcacattaaggctgagtcttaattccgtcattttgttttgtgggggttctcctgtgtacctagtatgaagttattattttgtgactacggttgtgtttttcttttttatattatccacccaactgtgtggaaggtagatatcttacttttaccctctttagtgatggccgtaaaattttttgtgagattatctctaacagctaatatcagttacaaatgattaataccttttttatggaagataagaaattaaatgttatctctttctcttttctgttctttgttaattttaatgtaaggtggttataaatatgttcctcccattttttacaacttttattattttcaatttaaaaaatatcagttttataataatattagaaacacttatcttgtctctatatctgtctttagtgcttactctcagctatacttaactcgttttctgtttcttatttttaattaatatatatttgttctgacataaagtttcccaaatttcattttatttttcaggaagtctacttcaagcattaatcctcttagtattaaatctgagaatatctttcacacatattcatacagatctgagaatatcttaacacacataaacaaatgggttagataaaaaattcttgggccgtaacctccttccttccttcccttccttctcttacttctcttccttctcttccttccttcccttccttccttcttctttcttctttctttttttttttttttttcttgagatggagtctcactctgtctcccaggctggagtgcagtggtatgatcttggttcactgcaaactccacctcctgggttcaagtgattcttgtgcctcagcctcccgagtaggtcggattacaggcacgcgtcaccatgcctggctaatttttgtattcttagtacagatggggtttcaacatgttggccaggctggtctccaactcctgacctcaggtgatccacctgcctgggcctctctaagtgctgggattacaggtgtgagccactgcgcccggcccataacccttttcttttgaaggtctacgagtgctccttcattattgttagggtttaatattgttaagtttgtgataacctgcttttccttccttgtgaataatctaatttggcttaggatgtaatcattatccaggaagtttgaaaatgtcaccagttcatattcatctgtgtgttctagtagtggtggtgcctggtgttatgttgttgttgtggttccttggaatatgattcacactctcagtttttagagacagggtctgactctgtgtcccaggctggagcgcagtggtgcaatcaaagctcactgtaacctcaaactcctgggctcaagcgatcttcctgcctcagcctctagagtagctgggactacagacgcgtgcaaccacacctggcaaattttttcaatttctttttggtagaggcggggtcttactgtgttttccaggctgtttccaaactcctggtttcaagtgatcctcctgtctctgcttcccaaagtgctgggattacaggcgtgcaccatcacgcccagcgtacactctcaatttttagaccgagttttctttctggaaaacatttgttcaacccttttttgttttttgcttttgctccacatatttcaatctctcttactagccttatccacagcttagatcctgggctatggccttccaatacccctcatagctgttctttctctatgtttttcctcagccttttatattctcatacatatatttcctgcttcactacttggaggttttccagtgagtagtctactgatcactggatttcatttttgtaacaatgctttctcctctctgtggaattatctcttgtcgcttttctaatctggctgatgtgacatcttttagttagttgtcgaggacataaactagatacttttctaacactctttggtggatctgttttagagctgggcagttgctgagtcagacgattgattggtggtggctgcctcagcctcccaagtagctgggattataggagcacaccagcgtgcccggctaatttttgtacgtttagtagagacagggtttcaccatgttggccaggctggtctcaaacccctgacctcgtgatccacccgccttggcctcccaaaggcatttcttgtagtaacaaaatgctccctgaggttctgggtctgtgctatgagaggtacttcttatttttcatttctggcctatttcagtgggtgaaacatttagatcaaaacaatagtaattgttatttcagacgctcttttgtttctgactttaatagtactgttccccagagttctgagtttaaacttgaaaattacatcgattgttgtctgagatggacattatttattatggttagggtaatatcttacttgtagtttaccctttttttctttttaagtcagtaacaactttgagtaactttttgacgtctattgagataatcatgtaatttttattatttgacttcatgatgaagtcaggtcttttcattatttgacttttattatttgacccttatttaattgaatttacgataattgaaaaactgctacagttcatggattacttctctttagctgagcttctctctctatatcctgttaagtttgactatttttttattttttaatttaggttttgcaaatatatccataaaaataattgggccaggtgcagtggctcacgcctgtgtaaaaatcccagcactttgggaggctgaggcaggtggatcacttgaggtcaggagtttgagacaagcctgaccaacatgctgaaacctcatctctaccaaaaaaatacaatgtagccaggcatggtggcacgggccggtagtcccagctacttgggaggcagaggtgggagaatcgcttgaactccagaggcagaggttgctgtgagccaagatcatgccattgcactccagcctgggcaacagagcaagactcctctctaataataacaataataataataataacaactacaataattgatccatttcattttctttccattttcaggtttttaataccagggttaggcgaaatgtatagggtatttgggacttttccatcttttttgcactggaagagattacataataaccattttcgagtatttgaacacatatttctgtgaaatcacatgaaacttaaaacagtttaggacagttctttaacaatatttagtttatgtcacgttcattaatgtacacaagtgatcattttctttagtggatccaatgatctattcatttcagaaatcactgatttcttttggatttcatatgtattaacataaatgtatacttgccattcttttatattttaatgttctttaattctgtaaatatatcatctttgagatctctaactttatatatttttttatctcttttttcgtaacctgactttcagatgattttccttatacatctatttttacccagagaattatatcactgtcttgattaatagtggtgttaggtcaatttttggagggaagatttgcattgtggattttaattctgctaggagttattctagtttgttgtattttttctttgttttcttcagcctctttttcatctcagcctgtaccacctgattttttactttttaagtgagacataattcaaataccgtaaaatgtaaagctcttgagttcagtttgatgaattttgacaattataaacagcagtaaaacacttattccaatacaaagtataaaacatttctattaccccaagtagtcccttgacaaataatttttcccactctgtggcttacatttcatgtcttaatataataacccctccttatccaaggggcatatgccctatgagcttcattagatgccttaaactgtgcataataccaaaccctgtatatactatgctttttcctatacataaatagttataataaagttaaatttatagatcaggtgcagtaagagattacaataactaatgataaaatagaacaatcttaacaatatactgtaaaaaaaggatgtgaatgtgatttccctttctgtcaacatatcttattatactgtactcccctttttaaaatatttttaaaaaatttgtagagatggggtcttgcagtgttgcccaggctggtctgaaactcctggtctcaagcaatccttgcacctcagcctcccaaaatgctgggatcacaggcttgagctgccatgttcttcttgtgataatgtcagatgataaagtgcctttgtgatgagatggaggtgaatggcgtgggcataatgacatagcgtttggctgctattgaccttctgaccgtaagtcagaaagaggatcatgtgcttcggtgatcctggtcatcatggagccatgacaatgtcaaaagtagatggcagcagtgactaacgggcaggtagtatagacagcttggatatgctggacaaaggagtgattcacgtctctggcaagttggagtgggatggcatgagattttatcacgctactcagaacagtgtgcagttgaagacttatgaattgtttatatctggaattttccatttaatattttccaaccgcagttgaccagttaaccaaggggtaactgaagccgcagaaagtgaatccacaggtgagggggaactactgtagtatcttttgatgagcagacatttgaaactttgattaaatccagtttatcacttttttctttcatgttcagtactctttggttcctgttgaaaaaaatctctgcctgcatcaatgttacaaaagtatcgtaatcccagcacattgggaggccgaggcgggtggatcacatgaggtcagaagtttgagaccagcctggccaacatggtgaaaccccatctctactaaaaatacaaaaaaatgagctgggcatggtggtgggtgcctgtaatcccagctacttgggaggccgaggcaggagaattgcttgaacccgggaggcgcaggttgcagtgtgagccaagatcagcccactgcatgccagaaaaaaaaaaaaaaaattttactacattttctgctggaagatttatggttttagcttttacttttaggtctgtgagccattagaaattagttttcatatgtggagtgtggtagaagttgaggtttggtttcccctgtacaaagttttagttattctaagtgtaatctgttttgttttgttttgttttgctttttgagatggagtcttactctgttacccaggctggagtgcaatggcgtgatcttggctcactgcaacctctgcctcccaggttcaagcgattctcctgcctcagcctcctgagtagctgggactacaggtgcacaccaccatgcccagctaatttttgtatttttagtagagacagggtttcactatgttagccaggctggtcttgagctccagaccttaagtgatccacccaccttggtctctcaaagtactgggattacaggcgtgagccaccacacccagcgattgttatgtagtatgtctttcccattgactgtctttaaggttttttttgcaagtttttggcagtctgtgctgtacttagatatggttcaagcgattctcctgcctcagcctcccaagtagctgggactacaggcatatgccaccatgcccagctaatttttgtatttttagtagagagggggtttcaccatgttggccaggatggtctcgatctcttaacctcgtgaactgcctgcctcggcctcccaaagtgctgggattacaggtgtgagccactgtgcctggcctatatgtattttttattccttgcattttcatttatttttatttttattttttttatagatgaggtcttgctcagccacccaggctgaagtgcagtggcatgatcatagctcgatgcagcctcaagctcctgggctcaagtgatcctcctgtctcggccttacaaagcactaggattacaggcacatgccacctcacctggctgatttttaaacacaatttttgtagagatgggggtctcactatttctttttaaataatttccatatctctgctcaaacccccaatttgttcacattttgtatttcaccatgagatctttggcacatttatcatacttattttaaattctgatccttacaacatctggaccatcttttaagtctgcttctgtgaaattttctcttgcatatcagtcacactttcttgcatctttttttgagacagagtctctgtctgtttctcaggctggagtgcagtggtgcgatctcggctcactgcatcctccgcctcccaggctcaagcgattctcccacctcagtctcccgagtagctgggattacaggcgcccgccaccacacctggctaatttttgtatttttaatagagacagggtttcgccaagttggccaggctggtctcgaactcctgacctcaggtgactgccctcctcagcctcccaaagtgctgggattacaggcatgagccaccacacctggcctgctttcttgcatcttctcataattcctgattgaatgccagatactgcatgtaagaaaaccctgcaagtctaaaataaataaaatctacgcaccaaagaatggcagaaccctcctgccaggcactggagtcaggctttcacgcaatgtaatccgtagttgagttggataggagttctgttacagctttagttgaagttggttcacagcaacttcaaagatttcgagggtaacatcaggactttctgttttgcagagcttgtgatgcgagcaatgagaaaactctgcagatgtctttatgctttatagtggagctgccaagctttctgaaccatgctgacattttgctcactgtctttttctgtccagttccaccatggttttctgggttttcaggaggtctccttccattctgtttctagtcctcaaagagcaggtgcaggagggacctcagccatggagggagggtctcagagggatttccctcagctctcctgccctatccaaccttcaccgtactaactgcctgcacccagttaaggtctaaggactaaagtagtggtgggtacagcatgctgttccgctgcggcattttggaatgtgactctgtcacagcagctgttaaaagtttgttccggcggagcgaggtggctcacacctgtaatcccaacactttgggagggtgaggtgggcagatcacctgaggtcaggagttcgagataagcctgaccaacgtggtgaaaccctgtctctactaaaaatacaaaaattagccggcccggtggcacatgcctgtaatcccagctactcgggaggctgaggctggagaatcgcttgaacccaggaggcagaggttgcagtgagccgagactgcaccactgcactccagcctgggcaacagagcaagactctgtctcaaaagaaaaaaaaaggtttgttccaggttaggcagcctcctcttgaagcccatgtctaccatgaatgaaaacctctgggagcctcttctctgctaggaaggactcatcactttgcagaatttatcttttttagatttctttatttcttagctctttgatggattagaaagataaatcaggctcagcagaggtatctggggtaggagagatgcccgctccaattaagaagccatctggatgagttctggctagtccagggaggagctaatggctgttctcagtaggtttcttagcagggctcatacctgtaatcccagcactttaggaggctgagacaggaggatcacgtgagcctaggaatttgaaaccagcctgggcaacctggtgagacctcgtctctacaaaaagataaaaactagctcggcatggtggtgcacacctgtagtcccagctactcaggaggttgaggagggaggattgcttgatcccaggagttggaggctgtagtgagctatgattgcatttgggcaacagagcaagattctgtctcaaagaaaaaaaacacacacaccaaaaacaaacacacacacacacacaccctatgattttgcatcttatgccaactgttctcattgttggggtgagggagatagggtcttgtgacttcctgcaattctaaccgtaattgaatttcccctagtttcttttggcttgtctttcacagttcatgttttctagaagtttctgctaacataacctagaccctttctactatgtttcttttggtttctgtggtacagtttgtgtcaagagtatgctgtttctgaagatggttttttccatagcaaaatccttcacacaccctgcagatagaatgctctcactgctgtacatcagtccttaaatgaggaacaaatgtccaggcctgacatgatcaattgcgaaaagtgagcgtgggtgcattgtcctcagctatccctcggaaagttctcatttgcaaatctgaaaccaattccagattaggcgaagggagctttaagaaggtcactggattgggcccggatactagaccagcaacaaacagggacaagctgaaaatgcacctaagtgtctccagtatcctttctctgtaatacgcacactaacacgatctcaaacctgttgagaacagccatcagcttcccctgggctagtaaaagagtggtttgctgatcttagcaggcgtctttcccattccaggtacctctgcccagttctctgacctatcagagcatacagggtgcgtggtgccttcctgcctggagtctgtgtggaaacccacccctcctagcacaccttgttcagcaggcacttcctcattcttgtgctgacagctttccttttctgtcaaataccccagggcacagtacactagggactgtcttatcctgcttctaccctctacaccccacattcacaattaacaaccagcttgttcattccacagacattagttgaacaccctctatgtgccatcccaggcacttggcatagatccacaaatgaaacaaacaaaatccctccctctgtgtgttacctgccaggtccgggtctgttctgcctgcacgcagtaaatcaatccctgtgacacgggttttgcaaaagagaaaagatttatttgcaagggcacggagtgaggaggcaggagaacagctgccaaatccacttccccaaagataaggctaaaggattatttgtgagttaggcaagtggggtggttttaaggcatagggaaaagtgattagtggtggggaaaaaaatgaagtaacaggttcgttctgcacaggtgtagttgggttcatggcatttcataggacatgtttacagtaaacgtggcattagtatgatctgaaggtggggtttttcacccactgatgtcaaaaggcaacctcttgggccaggtgcggtggcttacgcctgtaatcccagcacttcgggaggccgaggcgagcagaacacctgaggttaggagttcgagaccagcctggccaacatggcaaaaccccatctctactaaaaatacaaaaattagctgggcatcgtggcagatgcctgtaatcccagctactcgggaggctgaggcaggagaatcatttgaacccaggaggtggaggctgcagtgagccgagatcacgccacagcactccagcctgggcgacggagtgaggccttgtctccaaaaaaaaaaaaaaaaaaaaaaaaaaggaaaaaggcaacctcttgggcatttgcacaggcctagttgaagggccagtggtttcagtgagtctgaactggtcaggagctggcccaagttcctaaaaaacaacagaagcgactacgaccatggtgacccagaaatgtaggaatgacctgtacagtagccagtcttcacttaaccttcattaagtttcagcatttattaggttggtgcgagagtaattgcggtttttgccattactttcaaaatggcaaacaccaattactctcgtaccaacttaatagctgtgtggccgtgagctacgtggcaaaaggaaaagtaacaaaaataataaaaagcaagtggccaaaagcaagcaggtcaggaagacctggtcaaattaacaccttggttttatatggagtttatattctagtgggaatagactcctcttacatatcttaactcgatgttatccacacagtaaccctaggaagtaggttcttttattgttctcatttccagatgagaacacggaagcacagagaaattaagtcgattgcccgaggtctcccagtatgatctgaacaatgatgtctttgctttactcggctttgcatccttgaaggtcctcagccattgtgagctttgcatccttgaagaattcactgagcttggttctctattagcctagaatagagcctggcatttcgtaaggacctcatttcaaaatgcgaaactgcagcagccgagtaaagcaagtgctcaacaggactgacttccagtacagacgggcagcttcctttctcatctttgtctccctggctgttttttgtttgtttgtttgttttgttttttgagacggaatctcactctatcacccaggctgtagttcaatggcgtgatcacggcaacctccatctcccaggttcaggcgattctcctgcctcagcctcccaagtagctgggattacaggtgcctgccaccacgcccaactaatttttgtatttttagtagaggtggggtttcaccatgttggccaggctggtcttcatctcctgacctcaggtggtctgcccgccttggtgacctcccaaagtgcagagattacaggcacaagccactgcgcccgaccctccctgacagtgttcttactcagaaggcggaggggcccttctcggttcctctcctgggcagtagagttgctcgacaatctgggaatctgggcttcagtgtttggttgtctccagtatcagttactgttgccagtttttgtctgtttatggattttcatgggcattttaattaggaatcaggggaggagaagtcagatactgctcatctgctgccagggacagcttgcgagtctctgaggccttacttaagactcccaactacccaagaggaccaaaaacccactgcttgtgataaaagtgatggctgcagttttcccagagggacccagagtacaggtgggatcgtcgtatgtgtttttggttaatcctcattcccttctcggggtagctgcagagtaaaccactctatgaggataccacccaaaataatcatttctcatggggagctctgaaagcaaacatttattcaaaaattttaccaaacatatgcttttctaacacaccactcctcgctcccctaagcttccaaaagggcaagcacttggaacaactggcaaatgatgaatagattcttccctcatttacatacctagtcattagccgggattgctatggcaactgtaccttccagacatagacctgtgggcctagcacaacttcattttggaaactgtctagaagccttgtgctcctctctcagcgtttgacaggtgaggagaatttcagggggcaggaggagcctcgatgtttccaacagtctgtaagtgacaattatcaggtacctggcatagaaaggaaggaaagcatcttgctggaaaatagtctgcaaagtgatggctttggtttgctgactgcctctcttgtccctgggagcacgatgatcaaatgcaagcacaatgggtgtggtcttatttcaccagtgtcatttgtccccttggacacacacctatctgtgtgagatcctggtttgcaaacacatatacacacattcctatagattttgtccagggaaaacaagactcctttgaagagagacaggggttgggaaaaggaagagaataaaaaagagagaaaagagctgggcacagtggctcatgcctgtaatcttagcactttgggaggccgaggcgggcagatcacttgaggtcagaagttcgagaccagcctggctaacatggagaaaccctgtctctactaaaaatacaaaaattagctgggcgtgatggtgtacgcctgtaatcccagctactcaggaggctgaggcaggagaatcgcttgaacccaggaggcagagattcaagtgagccaagattgtgccactgcactccagcctgggcgacagagcgagactccgtctcaaaataaataaaataaaataaaataaatattccttctttgccccagctagtgtcctcctgtttgatttcagaactgtgaattccaattttattttttatggatacataatatttgcaaatacgtatggagtcctggtgatgttttgttacatgcatagaaggtgtaacggtcagaactaccataccacccaccaatgccactactactaggtatttatccaaaggaaagaaatttgtgtatcaaagaaatacttctcccttggttttgattcttggttttgctgtagcaagaggcagagaaagaggtaccactgcactccagccagggtgacagagcaagactctgtctcaaaaaaaataaaaaataaaaaacaaaacaaataaataaaagagagagaaaggatactggagacacttagaacgatgtgttttcaacttgtttctgttccttgctggtctagtatcctggcccaatccagtaaccttctcaaagttcccttcacccaacctggaattggttttagatttgcaaaagaattttccaaaggataggagatagtctctgaggagtggctgcccactactgttttcattctggagaagtgggtgtcaactggacagacagcaggagggcatgtctttgcttttttttttttttttttttttttttttttttttttgcttttttttttctagacggagtttcactcttgttccccaggccagagtgcagtggcgtgatctcggctgactgtaacctccgcctctcgggttcaagcgattctcctgcctcagcctcccaagtagctgggattacaggcatgcgccaccacacctggctaattttgtatttttagtagagacggggtttctccatgttggtcaggctggtctcgaactcccgacctcaagtgatctgctcgcctcggcctcccaaagtgctgagattacaggagtgagccaccgcacctggcctgctttttttttttaatttttaattttttaagttccggggtacatgtgcaggatgtgcaggtttgttacctaggtgaacgtgtgccatggtggtttgctgtacctatcaacccatgatctaggtattaagtccagcatgcattagctctttttggctgttgcagtttcacattttgaaatgaggtccttggccactgtgagctttgcacccctgaagattttcactgagcttgcttctctattagcctaggacagagcttggcatttcataggtgctcaagaagtatttatggaataaatgaattggcctcatctgtcctgggctttatccttcctctcctcctgacaccccctctcccccatgcccatgagtgcctatgccctgtgccccagagagacatccactctcagatccttgagaacttttacccttcctccccagcacatttgttctctctgctgtttagcttcccctgacacccagatgtctctatttgttgaaacctaacctcccatggcctgagggctttgaagatagggcagggggccagatgcagctatcagacaaaaggagcaaacttgacagtgagaagccaccagtgtcacagggaatctgaatacgctggtgcagggatggagctgagcagggccagggttgggcttgagcattgtcacccaggccaagacagggacaaagctggtcaacacaggctggaagaggagcattaatttcccacaaagtgtttactgagcactttctctgtggccgtcacccttcagggtaggctgtagagtaaggcacaggttcaaccggtagacagaaaactacagtaaactaggtaagttccaaaattctctaaagatagagactttgtttcagctgaactaaaaggtgagatgttccagcctatgcattttaactttcagcctgattgtctttattcctgcttgaggtggttaatcttatgtgtcaacttgactgggccaccgggttcccagatatttggtcaaacattattctagatgttgctgtgagggtgctttaggatgagattaacagttaaataggtagactgtgtaaagcagattatcttcccactagtgggtgggcctcatcttaccagttgaagttctgaactgaacaaagggctgaccgtcccctgacttagagagagctcctcctgcctgactgcttcagctgggacctcagtcttttcttgactttggactcaagctgaaatcttggcttttcttgggcctcagccctcctgagacttttggactggaatgacaccatcagctctcctgggtctccaatgtggctagaagtaatgcttccattctttgttttcataccatttaattaataagtttttgacttctgtttatttatagatcttatctcatgagactattaacttcttcgaagtgtgatctactccgatttatgtttggttccccaggttcccagcctaaatgtcctacacatggtagacatctcatgagtatttgttgattagtggagtaagtgaatgtttgtgggcttggcaagtaggttgtcagggcactgaatctgatgccaggtttcctgtaaaaggggtagatttggggccaggtgcagtggcttaagcctgtaatcccaacactttgggaggccaaggtgggcggatcatctgaggtcaggagttcgagaccagcctggccaacacggcaaaaccccatctctactaaaaatacaaaaattagtctggagtggtggtgggtgcctgtaatcccagctactcaggaggctgaggcaggagaatcgcttgaacgtgggaggcagaggttgcagtgagccaagattgcaccactgtactctagcctggttgacagagcgagaccctgtctcaaaaaaacaaggtatatttgctcatctgttaatggcagaggggaactggtcacaaagagtcattgaggtggccctgagaggtcctgccgctatgactagggcactgtgtttcctctgagacctatatcagactgtgtcttctctctggaaacattttcgttcatgggtccaatatgatatttttcttctctgaacccaaaacatgatcttttatatctcctcactggttcgctttctcaattaatcaaccgaaggctggttttgactgtctgatctagaaagactaatacagtagttttgttcatgttttaacctgctatacgatggttagtttcttcagggcagagacctgacacttgattctccccagttcttatccgactccttgcacctaataggtgctgatcaaatatttattgaaagagggaccaggccaggcatggtggcttttccctgcaatcccaacactctgtgaggccaaggcaggaggattgcttgagctggggaattcaagactgacctggacaacatggtaagacctcatttctagaaaacaattaaaaaattagccagtcatggtggcatacacaggtagtcccagctactcaggaggttgaggtgacaggatcacttgagtccagaaagttgaaactgcagtgagccatgtttgtgctgctgcactccagcctgggtgacagaatgagatcctgtcccgaaaaggaaggaaaggagaggagaggagaggagaagggaggggaggggaggggagaaggaagacaggaaggaaaaagacagagagaaagaaagaaagaaaggactaaatgcagccctaattccacacagataaacacttttattattcccctcccctttttctccaggctggtgtttaatcaccacacttgtagtctgaaattgtaggtttttgaagccacagaaaagcaaaaggaaagcagatcttactggaggcactacaactgtttttgttttccatttgtttattgtgtaaaataaacataatataaattttaccattgtaaccatttcgaagtatatagttcagtggaaataagcaagtaaatattgtttaataagcatcactactgtccatcttcataacgtttttcttcttggaaaattgaaactgtactcattaagcaataaccccattctcccttccccccagttcctgtcaaccatagacactttctgtctctatgcatttgactactctgtaagtatctcatataaatggaatcatgcaatatttgtctttttatgagtggcttatttcacttatcataaaatcctcaagtttctcccatattgtagcacatgtcagaatttccttccttttttagattgactgataagtaggtaattacttctgtcattcacctatttgtttcccatgtgtcttaaagctttttgtccatcatttcctgaattgctgtcttcttttgtgtgtagtgatctttttgtagtgaaatatttaaattattttctcatttctcttttgtatatattttatgtctattttctttgtagttaccatggggattatatttaacatactaaagttatacattctaatttggatttataccagcttaactccaatagcatataaaaaatgctgctttataacttcatccccacttttacatgttgatgtcacaaaattacctctttatacattatatgggcaaaactataaattgataatttcttttaaaaaattattaacctcttaaattgtgtagaaaacaaaatgtagagttacaaaccaatgttacaataatactagattttataattgcccacataattgcaccatttttttgtgatctttatttcttcatatcgcttcaagttactgtctagtgtccttaaatttcaccctgaaggactccctttagtatctgttgcagggcaagtctagtgataacaaactgcctcagcttttgtttaggaatgtcttaatttctccctcacttttgaaggacagttttgctggatattggattcttggttgacaggctttttttcttatagcacattggctatatcagcccactgccttctggcctctaaagtttttggtgagaaatctgctcatactcatgttggggaatttgtgtggaaatatgcttctctctcaccactttcaagattttctctttgtcttttgaaagtttgactatagtatgtcttgatgtgggtctctttgagttcatcttagatgaagttcattgagcttcttggatgttgatattaatatctttcatcagattgggggagtttccagccactatatcttcagatattcccctacccttttctctttctcaggtttccataatgtatatgttggtccacttgatgatgtctcacacatactttatgttctgtttgcttttcttcagtctttttttccttctgctctgaagaagtgataatttcctttaagctagcttcaagttcactgatctttttttccttctgcctgctcaaatcacccatcttctttataacattgttttcttgactttctctatgtcttccttctttgagcatgtttaagacggttgttttaaagtatttgtctattaattccaccagtaggtctttttgaaagacagtttttgttgatttattattttttcctttgaatggaccatactttcctgtttctttgtatgtcttgtgacgttttgttagaaaactaaacatttgaagctaataatggagtacctctggaaattgaattctccccattctccagcatttgttgttgtttttgtttgttttttaattgtcataggctgtctttgggccaacgatcagtttgaggtgtaaatgtaaggtcttctcaggtcttttctgagcctgcaccttttcatggatatgcatgatttttttttcttatttctcctgtatgtgtgattgcttttaaatatcttagtctttgatgtctgacttccaaaagatggaaagagaaaaatgaaacgggggaaaatagtgctgcctctaaatcctctggaaatcatttcagctgcagggcagggttgggggtggggtggagcttatacaatgggcagaggtgtagcaacagtggcccctgcctctttgtctgcacctctctggtcagagcacggaacccctatatttggaggacagggtgcttttttgcccaacctgattcctgctggctgcatgcaagctgctccaggaacatgtgcacatctccctgccatgggattgggagtaggggatgggtagcggctactgtgctaagagctgaaattgatggaaattaactgcaatttaccaaccaagcctttccctggaagttgcaagccttcaatagcctggaatttcaaaatagtcacacaggacaaattctgccagcatgattgttgtccaggtggggaaacagattcctagtgctctctgctttgccatcttctccatccagttttgttttgactttctgggtgaactcaattaagcctttgcattggaagctcttctatgttatttcacagcaggcctcatgaaccaaatgtccaataggacttaagaaattgaattatagacaggggaggagaccttataaaaactgcaaagtttggtcccttcagactgaagtggcaaagtctaacagggggacgagattaaaatctataatgttgtaagtacagagcattcgcccagaatcatatgtcagatttggaaattaataccttgtggtcccttttgccttgaatgagaagttttggatacaaaattaaatcctaattcataaagccacaataaagtcagggaactcttcatatcccttgaagaagaacgaagtgggagaaataaataaattctaaaagggcccaagcagattcatgaatcaccaataattatgaagagcaggtggaatatatttaatatttgaggttgccatcaggaaggagaacctagctgagtctctgaggtttccgtaaacaacagaatgctgggccaggcagagcctcatggacctgcagcagttggacacattctctgactcaggacatacctcatatattctgccttgctcctgaggaagcaatgtaaaagcgaggacctagtgcaacttttcttttagtgcaagtttttacgttttgggagagagaaagatgggaatgccataatgattctgcattcccaaaggcatttcaccttcctctgccctcccttttcatatgtgttgttatagttgactgaccaaactagttttgacagagaggctgttttctttgcagtgacaaggatttttcctaaagcaattagaaaatattaggtagaatagagaataggatggatcaaggctagagggagttgcctggagactgtcaggctctgggaatctctctcttctgtgccccatagagtttggggacagatgttgttcttgggaagggacactcctggtgaggacctcaggacatccccaagaggtcatagttgggctctccctcccttttctgactgcttttgcactcattatgccacttatgtaacactttactttattcgtaccaaatactgttgcttatgcataaaccatagaatcctagtatctcaagatagagggagattgggtaggggtatggtaggctgaaaaatggcctcccaaagatatcaagctctccctctttgaacttgtaaatgttaccttatttggaaaagaggtctttgcaatcctttttaagttaaggatttggggggagattatcctggataatcagggtgggttctaattgccatcctgtatccctctgcaagggaggcacagggagatttgacacacagagaaaagaaggccttgtgaagatggagcagagattggagtggtgtagccagaaaccaaaggatactggagacaccacaagctggaagaggcaaagaatttatgctccctagagcctccagagggagtgctttagatttggccccagtgatactgatttcagacttctggcctccagaactgtgagatcatcatttaggtcatgttttgtttttttaaagccaccaggtgggtgatacttggctacaactgcctcaggaaactagtccaagatgtcacctcattacacccatccaccaaggccagtgtcccattaggttggtgtctgcctgagcagcggggacccattacctggctgtgacatctcatcctgaggtcagagttctgacagttgcagtggttctcctgaagtctgcgattccgcacggacgtctccagccactttgcagtgtcacttgccctctctgtgtgcactggcatctgctcctctggatggccatccaaattgttcttgatgggaaagcaattttcattgtactcaaaagcagttctgaactctcctgcaacttagaatcagtctatatctacttccaagtgttttcagtgtacctatttcctccagtttttccaccgtcctcaatcaataagataatcacaataataaaaatggcattattttacatctatgtgatggtttaaccatttgggagattttttctttaatcatcttgtgtcaggtagctaagtgagtattattaatccaacaaaaaatatgcaaaatgaggcccggcccagtgcggtggctcatgcctgtaatcccagcactttgggaggccgaggcaggcagatcacttgaggccaggagttcgagaccagcctcgctagcctggtgaaaccccatgtctgctaaaaataatttaaaaattagctgggcatggtggcgggcgtctgttatcctagctacttgagaggctgagacaggagaattgcttgaacccatgaagtggaggttgcagtgagctgagatctcgccactgcactccagcttgggtaacagagtaagactccgtctcaaacaaacaaacaaaacaggaggcccaaagaggaggaatgacttggtttaggtcaataagccatgattacaatccaggatttgtttaacttcatcatggttgataccactgggattcaaagtggtgtgcgtgtagttaaagggttgtgggaaaaatccattggggtataaaaagaaaatattagaaccttctcgtatctatttctcatctaaaattaagaatagatctctgttaatatttgatgagtaaatagtgtatgtatataatttgcgaataaatgaatgtcatgtatattttaaaatcttttgctggtggaggtgcttgcatttaaaaagtagggaaattgctctcccctcaccctgccccatcgttgttcattttagccaagattgactatttaagctttaattgaggatgatatttatgcattaacacgtgggcacaaattggttggtgataatgagattgctgaattagtttagtttacctcattatctggtagccaagccagacttgtaaataatgactaagatacaaagcacacagaagcagatacagagggaataactttgaaaaattaaaacattctgcaaagttgcaaggccgtgtagaatcagctgactttccttgcctgtgactccttcctggtctgtatctgccaccaaatgcagatgaagaggacagcagaaggtggtctgaggtcagcccttgctggacctggggcccaagcataccaagtgccgctgcccaggtacatgagagaggcatgccattcggtggatcagcagtcagctcactggactcctccttagcatagcgattggttgtaacttattgacagattcccctataactttttattgagagatagctgatttttttaaatttttctttataagatactgctttccagagtgctctggaggcttgagagagtcatagaaaaattatggagtggctgagagtggttgctcatgcctgtaattccaacacttccggaggctgaggcaggaggatcatttgaggccaggagtttgagaccagcctgggcaacatagcaaaacctcgtctgtattaaaaataataatagaaaaaattggctgggcatggtaatatagcatctgtagtcccagttgctctggaggctgatgcaggaggatagcttgagcctggaaggtggaggctgcagtgagccatgatcacaccactgcactccagcctgggtgacagagagagaccttgtgtctaagaaaaggtatggagaaacctattttggctctgtagatgtcaggctctacctaaatttctgcctctattttcccatctctgcgtcacttgaccaaaacatggaagaagcctttcctttgatttcagacccatcctacttggggagtaagtacttaagaattatagttccagctgggcgtggtggctcacacctgtaatcccagcactttgggaggccgaggtgggtggattgcctgagctcaggagttcaaaaccaccctgggcaacatggtaaaaccccatctctactaaaatacaaaaaaaaaaaaattagctgggcatggtggcacgtgcctgtaatcccagctgctggggaggctgaggcgagagaatatcttgagcccaggaggcagaagttgcagtgagccaaggtcgtgccactgtattctagcttgggcaacagagtgagactctgtctcaaaaaaaaaaaataaaataaaatagctgggcctggtggtgcatgcctgcagtctcagctactcagaggctgaggcaggaggattacttgagccaaggagttcaaggctgcagtgagccgtgatggcgccactgtactccagcctgattgacagaaagagaccctgtctcttaaaaaagagtcatacatatagtagctgtctacaaaggcagatcgaagcaggtacggttgcatttggttgtaaagcagtaagcagaaagggacagttggttcctggaaacattcacttttatcaaaaaaaaaaagtactgaaaaaaaggaaaatgagtgccttagacagagtgaatctggatttcaccaaagcatttgacaagtttacattgacgaatttggtatgtgtgtggttaagatagaaaaatatgagctggatgctactgcaattaggtagaagtaggactgggtgaataattatgcccaaaggaagactcccagtaacgtgccccagggctctgtcccccactttattgtgttgaaaagttttagcagtgcttccctgaagccagtgcctgatggaattaagatccaaaaaggtcttgacaggctgagacaattaggccgaatccaacacgatgagatttagcagaaacaattgtaaggtcctgcatttgcatccaaacaatcaactatacaaaaacaagagaagaaaagtgtgacaagagcaggaccagtttccagcacaggtgcaggtgacagacttgagcttggatgtggatccacagaatgatgggactatcaataatgcgaattttacttggaggctgcactgttagaggtattgcatcatatcaaaataagtaattatcctcctatccttgctgtttctttttttcttttcttttctttttttgagatggagttttgctcttgttgcccaggctggagtgcaatggtgtgatcttggctcactgcaacctctgcctcccaggttcaagtgattctcctgcctcagcctcctgagtagctgggattacaggcacccgcctccacgcctggctaattttttgtatttttagtggagatggggtttcaccacattggccaggctggtcttgaactcctgacttccacacagatgaagcgtggggttcggtcctgctttcctcaccttgagatcccacagaggacatttggaggcaagaaccgggatctcaatgggactccagaatacatactgtaatgaatccgagatgggattggggatgcttgctttatagagaagaataggtgaagatatggtagttgtctttaagcagtttaggttgccacttggtatttgaagggttgtcatgcaaaagaagaatgagtctgtttctggggtggctctcaagactataacaaggaccagctggggcaggggcaggggggcggggaggccactgctgtgaaggcaagagtttgatggaaagtagagttatgtggctactaaaacttgcagcagtcaacagattgggctgtagtatgaacaaacagtacaactaatagttgagattgctggccatgatgcattgttgatttaaaggtagcccatgttttgttggatttcaaatgtctaggtgataaaggtcattaaaatattaatattttaatattaatattttaaaatataaatatattttacatatattaacataaatatattttacatatattaatattaacatataaatatattttacatatattaacatataaatatattttacatgtatatcactatttcagaatattaatatattttacaaatagcctgatgtctgtttgtgcccaagtgcactgcagctatgtttctgcacagaagtggtcctagagccacataataacagagctcagattttttttttttaaaaagatcagcctaggatcagcttaaatgcctgagcaagcaccaatacatccataaaagctatgcaagttgagtgtcccttatctgaaatgcctgggaccagaagtattatggatttttgaggggggatggattttggaatatatgtattatacttactggttgtgcatccctaatcaaaaaatccaaaatcagaaatctggaaggctaggagtcttgcatcatggatcatgaaagagatgaccttgagttagaagattctatgtcaggatttaacaaccatccctgtctatgttaaaataatagttgttgcaaaatatatgatttttactggggttatatcaggatagcttgtcaggatttgctggctacaaaacccttccccacctaactggatcagttacccaatctaatagagctgtttagaattgtccatctggctgacaaagagcacctgccaaaagtgattagttttgccttaccttaattgattttgagtaattttctcctcagaaagttcacttgcaccttgagggggtcatagaatcttcatagagaaaaacgagttttcatttttatttttacttatttttaattaattattttttttttttttgagatggagtctcactctgtcacccaggctggagtgcagtggcacgatctcagctcactgcaacctctgcctcctgggttcaagtgattctcctgcctcagcctcctgagtagctgggattacaggagtgtaccaccatgaccagctaatttttgtatttgtagtagagacgtagagacggggtttcaccatgttggacaggctggtctcgaactcctaacctcaggtgatctgcctgccttggcctcccaaagtgctgggattacaggcatgagccaccgtgcctggccagaaaaagaagtttttaaatttgctattacaagaaggcatatgtccaattcatccataaaagctatgcaggttgagtattccttatctgaaattcctgggaccagaagtgtttggattttggattttattttgggggtgggggtgtggatttgagaatatttgtattatacttactgattgggcatccacaatcccaaaatccaaaatctgaaatgccccaatgagcatttcctttccacgtcaggttgtcactcaaaatgtttcagattgtttagcatttctgatttcagattttaggattagggatactcaacctgtataaagtaattcaaatagatattcagttatactatccaagttttgcttttttcagctgccagtacatggaatgatttggttttgttggctctcatggcaagtctggagataagatgagctcttggctggtgaatgcagccactcaagatgccaggcctctatctagctcagcaactctgcagttctcttggcttctccctgtggatacaggatggctgctatatattgcatcttcacaggacaatatgcaaagccagggctgtccccttttaagagagaggaaaactttcccaagagacttatggcattgcatgtcataccattttgaaagattattgtatggctttgcagatgttgaaactggcttcttaatgcaatctgagagttatggccctaaaacatttttagatttaaaatttaaattttgaattaacatacaattgacatttgagggtgtaccgttctgtgaattttaacacgtgtaaattcatatacatgtacaggtcagcacattcaagatacagctcaagaacagcttgatccttttttttgatcaggttttgacaccaaagaaaaccttatgtctttgtgtctaagttcatgagaggtattagactctaggtgtttttttgtttgttttttcttgtaatgtctttggttttggtatcaggacaatgttaaccttatcaaataaactgagatgtgttccttcctcttttattttctggaagagattgtgtaaaattggcattatttatccataaagaaaaaaattctttaaatgttttggtagaatttgccaaggaagccatctgggcctcaagatttcttttttggaaagttttaaactgtgaatgcaatttctttaataggactatttaggatgtgtctttcttcgttggtgagttttgtattatctgaagaatcaatccatttcctttgtcattctagttaaaggtttagatgttatatcaacctacattgaaaaccacatgagacaatgttataatttttgttttcaaccatagaacatttttaaagaaccaaacagggtaagaataatcttatatttacccatatatttggcatttcttatgttctaagttcccttctggtatcattttatttatttattttttttctttttttttttttttttttgagatagagtctcactctgtcgtccaggcttgagtgcagtggcatgatcttggctcactgcaacctccacttccctggttcaagagattctcctgcctcagcctcccaagtagctgggactacaggcatacaccaccacatccagctaattttcgtattttttagtagagatgaggcttcaccatgttggccagactggtctcaaactcctaacctcaagtgatccacccaccttggccaaagtgctgggatcacaggcgtgagccactgtgcccagccctggtatcattttatttctttctggagaacatcctttaaaattttttttagagcaggtgtgctgacaatgaatttctttacttttcttcattggaaaatgtcttcattttgactgcattcctgaaggatgtttccactggatgtagaattctgggttgacagttttttatctcttggctctttaacaatgttgttccacttccttctggtctcagtgttttatgatgagaaatctatagtcattggaatcattgctttctgttggtaatgcgtcatttatttctgtctgattgtaagatgtttttctttgtctttattcttcagcaatttgattgtgatatgtttgaggatgtattattttaggttcatcccatttggggctttaggggcttggtgaatctgttggtttatttcttttttttttttttttttttttgagacagagtcttgctctgtcgcccaggccgttttatttctattgagaaatttagaaagtttttggctattatttctttaaatattttttcttctctgcagcctttctcatctccttttatgcctctgatagtaggaacattaatcatagaagaagaggagaaagactcacattttttattgacctatcttcaaattcactagctcttctatcacctccatttctacattgagcccctctatagagcttctttgctgttactgtttttttttttttagttctgaaattttcattgtagtcttgtttatatcatttatttctttgtctagactttctattttcccattcctctcgagaggatttgcaaatgagaggagtggaaagatagaaaaagataaaaacctctcaacaaagaaataagtgatataaataagaacacagtgttaatggtttcattaacatctttttcagataattccaacaactgtgtctgtagcgtctggtgattgtgttttcttatacaggtcaaattttcctgcttcttcatatgctgattaattttgtattatcgtctggacattttgaatattacgttatgagatcccggctcttctttaaatcctccagagaatgttgatatttttgtttgagcaggcagattgagttggttgggtgtaggctgaaaattctgaccagctttctttggattgtggtctgttcagttttccaaggctttgcaacactattcagatctgttctgctcgtgctccacccgttggccattctgggagctgtgtagtattttgtcccattgagttagttgttgctatggaggagtttgccttggtatggagaaatacctgaaactgagtaatttataaagaaaacaggtttatttggctcacagttctgtaggctatacaagaagcgtgacacccacatctgctcagcttctggtgaggcctcaggaagctttcagtcatggcagaagggaagtagagctggtgtgtcacaaagcatgagagacgggggagatcccagactcttctaaacagccagatcttgcgtgaactcactaccatgcatcacggtggggagagcaccaagccatttatgaaggatctatcaccatgatccaacatctcccacaggccccaagttcaacattggggctcacattccaacatgagatttgaaggggacaaatatccaaaccatctcacatgttttccagttttcagagtctagggcagactgtttagggttagacaggcatgaacaacttacaggtgagcccaggatttcatacacaaaatggcggggtagctttgccaacctcttcactctccaagacctccttggtactaccatttatttaggactctatttttcattcctatgtccagcaagctgaggctttatttgtcctactcttatgcatactttccttggctgtatcagcttcctgatccaagctacaagagaagagaaagagaaaaaggcatcaggcatttgttcctactcgagacaatggttccactgatcagaaggaaaggttctccttcagagcatgtaagcacctgcaggttaccatgggttgaggcatgaagaaatggtgaaatgaaaagacaggaagtatttcccccactctctctgaatgttagagacccttttcctacccctcaagccaaaactagaggcttcctggagctctcaccacccacaccaatgcccactgcccggggtctttagcattgcatctagctgggggtactcgaggaaaaactgtagcaaactctttgctggtttggtggtactttaaattcaggtcttctccaaatcacctgctactacaacttacttctcagaatccccaaatagctgttccatgcgttctctgcatgttccacagctgccagcagtggaaagaagcagggtagagtgttgcttcctctacccatcatcagaacctctcagaaatttttcacagttttttttcaacctaagtggttaattgaatgtttcatcataaatgaggtcactataactaagttatgggaaattacaggaggactgggattataaaatactgagtgaatgctgtaaggattcaccaaaatatagggagatcagctgtcatgagtcttttgctgtgggtaccctgagttcacaattgacggtcatttgcaaccttgaaagctaagctctgaaacctattatagttcaatttctttttggaaatattatgcttctaacaagatttcagagcaaggtaatttccaagtagtttcctttaaatttagcctgaagtattgacttactggctttttttttcagaaaacttttgccaaggcaagaatgagggttgggagttcctaagtatgagggattgtcagggtttgcttcaatctgcccatattttcttgacatgggttattgaagaaatcttcatccctactgttgtcatttgagcattcctttaatataccatccctatcataccattgctaatgaagaccaggtaagtggcaggaaaaagtaatccctctgacctacttttaggaggtctagatcttggaaagatggagacagattttgaagaccatagatggaatgacattcctaagagtggtttgttaattttccttgataaaggtttctgaaactgacgatttaaaaggaatatattctgtacatctcttgtgaatcccagaagttttcaactgcttaatccatttctaaagttttagtttaaaaatataaatgaaattggatgttcacaatccaggaagcataacatttaggtttaagtccaagtttaaaaccttgaatcttcaacgaaacggaaacatgtcaaaatgattacacttcctcctgttgacagctgggttttaaagccagacagcgttcttcgttttcgacttttgtttttttaatgcagaataccatggcttcttttgcacgtcactgtccttttgcactgcattgcaactcagcatccccagtgtctatgatctatatggggcaaaggcgtatttttcatagagagctttgtgaagttattcttctccactatttcagttcagagcttaccatcttccaaagtcctgcccccttggccctctgcccagggtgtggacagacactcttgggtgttctctaaagattccagcttgttgaccaggcatggtcgcttgtgcctgtaatcccagcactttgggaggccgaggcaggcagatcacctgaggtcaggagtttgagatcagcctgaccaacatggtgaaaccccatctctactaaaaatacaaaaaaatagctgagtgtggtggtgggcacctgtaatcccagctacttgggaggctgaggcaggagaatctcttgaacccgggaggtggaggttgcagtgagccgagatggcgccactgcactccagcctgggcaacagtgcgagactccgtctcaaaaaaaaaaaaaaaaaaaaaaaaagattccagcttgttgcagcttgtagcaacccccagcagccactaagagatatttactcccactttttactcaagcaagttaatttctggaggtgaaacaattgcacttacgatcatccagggtctcatctggataagacttggtagcacgtgtaggtgtttaacgtggcgtgattatttaatatatgtggtatagtggtggggccccagaagagcaattttctatacaattctaattttgcgtgaaatgatccggatggtggttgtataacattctggataatatgggctggtgccaagtgacattttaacttctgcacgacttagaaaactgtgctacgtgttccacagaggaaattatcagcattcagctgcagtattcgcttgccagaaccattacccctcaagaacgctttcatgtagacgcttgaagacttgaaaaagagaaacaacttcctgttccattacaaacatatttcatgccaatacagaaacgataagaccacaccaaaataggggatcaatggagaaatctatggctttctgtaagatgtcatacaactaattttattatgaagaggtttttttttcccaataagtcttctacactcattattgtaaagagttttaataacatgtaatcttcacaatacaatatcaagtaaaaaggactggaaaacataattttaattattttgtttatttgcttagaagaaaatgaagaaaaaatacacgtatgttacttctgggcgatgggttgatttttcatttcctatttatattccttattcttttccatttctcactgttacaaataatgttatgataaacagcatgatgcagaaatctatgaccaaatttctgaacacttcattgggacagattccagaaaaggaattactgaatcaaaaaaaaaaaaaaaaaaaaagaacatttaaaaaggaactttttatctaaatgccattgccaaattagtatccagaaagtctatgctcatgtctgttaccatcagtattagtgagaagactcagcaaactgtgtactctgtcttttcacttaaaatctggccaggcttcatggctcaagcttgtaattccagcattttgggaggccaaactgggaggattacttcaggccgggcgttcaagactagtctgggcaacatggtgagaccccatctctacaaactttttttttttaaaaaacaggtgggcttggtggcatgtgcttgtaatcctagctactggggaggctgaggcaggaggggcacttgaggccagaaattggaggctgtaatgatctatgatcatgccgctgcactccggcctaagcaacagagtgagaccttgtttttaaaacaaacaaaacaacaacaacaacaaaaatgaaataacattgcatactggggatgtggaaaatgctagctcactattgctttaatttgcatttattttcatattattgaagttgaacattttctacatgtttaatatttgtgtttgtcttttgtggattatctgtttttatcttttagtattcatcttttaatgaatttcttcgtatttgaagaatgctattcttttgccatattcattgcatagagttttcctagattattgctaaatatttaatttagtccctgatgtttttaacatgcagagtatgttagcaagtctgtgaatctctatttttttgttattcctttattgattttaagcttagataggattttcttcattttacctatatatttctctaattttttatcctctaattcatgttctagagtaaaatgccaagtgaggaataaaatcgatttttcctttcaagttctttacctgtcttttcagcaccatttgttaactaagcctccttttttccattcgattttttatgtttattatctttatttactagggcttatttctgaattgccctgttttgtttatctcctacttaaccttcatcagtacttttttattgtggttttataatagattttattactagatatagcattactgtccttaattccttttagaggttttctttcctgctcattcttccaaatgaccaattcactgggacatttccaaaaaaattccatagggatttatcctgaaattgcattaaacatatccattcatttaagaagtataaaattgttagagtaatccttctaccaggaagcatggtattcttttatgttttcttttaaaggctttaaaaatatatcactaaagttgtataggtttcttcatatgggtcctaaatgtcttttattttttaattgagacaggatcttgctctgttgccccagctggattacagtggtgcgatcatagctcactgcagcctcagctgctgagctcaagcaatcctcctgcctcagcctcctgagtagttgggactatgggtgtgtgccaccaagactggctaattttttttatttttttgttatttgtggaaatgaggtcttgctatgttgcctaggctggtttcaaacttctagcctcaagcaatcctcactcctcagccccccagagcgttagcattacagatgtgagccactcagcttggtgctaaatgtcataaactagtaatttttcaataaaattactcatttcacaaaagttttaaaatgtatttgctttcagctatataaagtacagtatttcataatttttatctcctctgtatttgttgctacatagtttttgtctgttgcaattttatttgaatctttctgggttagatttgttaattattcatatgttttatagttttctcaaagaatcctcttttttttgcaacgatgattaccatatctatttgtgtatttcccagttaactaattctgcctttcccctaattctatcattacccctattaccatatttatgtttaacttttctaagttttaatttctttgctatttatgtctttatttgcattggggttactttttctattatttgtttaatcagcctctgttaatctttaccagcttggttaaaatgatggactctggagttagactgccaaattcagaacccccgcctcaccctgccccacccagccccaggtctggcccatgcaaattgagcataagctcttctgatttccacttcctgatttaggacatgaaatagtaataatatctacctcgttagtgtggtgtgaggattaaatgagttaactcatgtactatgatgcctggcagataaaaaatgctctgtggatgtcagcgatcatgaacagcatttctcttccatccgttcttttgttctttctttggaattcctgtcctcatcaggttagacctcagggatcttagtctccaggtctctcagcttttacctcccagtctctagctctgtgtgttttgttttgttttgttttgtttttattttagtttccagagcacatgtgcaggtttgttataatagggaaactcctatcacaggggtttgtcatacggattattttgtcacccatgtactaagcctagtacccaataattatttggggtactgtccctccttcaccttcaagtaggccccagtatctgttgttcccctcttcgcatccatgtgttctcatcatttagctcccacttctaagtaagaacatgcagtatttggttttctattcctgcattagtttgctaaggataacagcttccagctccattcatgttcctgcaaaagacatgatctcattctttttcatggctgcatagtattccattatatatatatatatatgtatatatatatgtatgtatatatgtatatatatgtatatatatgtatatatgtatatatatatgtatgtatatatgtatatatatgtatatatatgtatatatatatatacgtgtatatatacacgtatatatatatatatgtacatatatgcagccaacaagcatacagaaaaagctcagtatcactgaccattagaaaaatgtaaatcaaaaccacaatgagatatcatcttacaccagtaagaatggctactatgaaaaagtcaaaaataactacactgctggtgggaatgtaaactagtacagccgctacggaaaacagtgtggagattccttaaagaactaaatgtagaactaccattcaatccagcaatcccactgctgggtatctacccagaggaaaagaagtcattatacaaaaaaggtacttgcacatgcgtgtttatagcagcacaattcgcaatagcaaaatcatggcaccaacccaaatgcccatcaatcaatgagtggataaagaaattgtggtatatatctatatatacgatggaatactactcagccaaaaaaaggaatgaattaacagcatttgcaatgacctggatgagattagagactattattctaagtgaagtaactcaggaatggaagactaagcatcgtatgttctcaccgatacgtaagagctaagctatgaggacgcgatggcataagaatgatacgatggactttggggacctggggggaagggtgggaggggggtgagggataaaagacaacaaatatggtgcagtgtatactgctgggtgatgggtacaccatgttctcacaaatctctaaaaagcttactcgtaatcaaataccacctgtaccccagtaacttatggaaaaataaaataaaaaaaatagataaactttgataaagattgcgaaagaaaaccaaagttgctacatagatcttaaaaaaaaaatgacacatgctggtaaggttggggagtaaagggaacactcatatatgttggtgggagtgtaaatcagttcagcccttgcgaaaggcagtgtggcgattcctcaaagagctaaaaacagaactgccattcaacccagcactcccattactgggtatgtgctctgagttgttgttctgtgcagtggttccaggctactgtctcagttcctatcacctaccagccggtaatttcagagtgtctatgaatctgcatatttgaaaatcatgctttttactttctgggagtctttggtgtactctgattccactctttgggagcacatattcctttgtttgtttgttttttgagacagagtctcgctctgtcacccaggctggagtgcagtggtgagatcatggctcactgcaaactccacctcctgggctcaagcgattctcctgcttcagcctcccgagtagctgggattacaggctcccgtcaccacgtctggccaatttttgtatttttagtagagactgggtttcaccatattggccaggctggtcttgaactcctgtcctcaggtgatcctccctccttggcctcccaaagtgcttggattacaggcgtgagccaccgcacctggccttggcctctcaaagtgctgggattacaggcgtgagccaccacacctggccttggcctcccaaagtgctggcattacaggcgtgagccaccacacctggccaccctctaagttcttacctaagtcttctttctttagttgtagtcagtgggaaccaagtgcttcaaaggctcattgagtcaccctgtctctggtcactgagacggggtgagttgtcatttctgagactgaagtgagttgtcatttctctgcctggctgtagatttccatccgccttctctgccaagtcagggcaaaggcacaccaacaggttaggggaagcccggtggttttcatgttcacctgaccagaaacaagtgtgcctccttcctgaggtcaaggaggaagccccctctctttagggtacatcccacccaggagcaggagacacgggctatagagcagattttcttcgggtggtcagtagtcagtgaggtcaagaccatcacccccaagcctgaatccccccagagcctgctggagtaaacagttgtggccctttctcggggagcttcctggggaaggggcagatcctccgtatcttctctctaccttccctccagagacctgccttccctggccggtgtccactccggaggcgacttgtcgggacggcagatcaggagttcttgctgttatatattcacagccccttaactccgcatttactccattttctaaatggttattgctgccacacaaggaaacgattgattttttaaatgtttgtccaggacccagccactgttagtaaattcccagaattacgatggagtcatttctttttttctagatagacaatcataccatctcctgaatagtgatcatcttgtctcatgaattcctttagtcatctttctcacttgtatctcaagtcataatattggccagaacacagaaaacaacattgaataaaaatgataacaagcatccttggggcattgcttatgttaatggaaattcctctggtgtaggagaatatgcttctgccttgagatagatcactcttactttgtcgagaaaggattattcttgtccttgttctaaaaagtcctgaaggaatctagtattttccccagcactgtttgcagcttccatagagaccaccacactttttattgtgtctattgatttgatttcatacatggattgatttttctagtattaaattgtactcaagttctggaatgatctgtacttggctgtggtcagctatgtttggagcatattttaaattagattttccagttccagctttagcgtttttgcatgtgagatgtgttggttggttttcttttgtgtatttttgtatgagagttatattagcttttccactttttcttcatcctggaacagttaatataacatgaggagtgtctatttctcaacaacaggaaaaaactcagatataatttttcctaatttgagaagcttttcaggtattttttaaaaataggttatcagttttagaaatctgattttgttgattttctgcattttcttaaatctgtaataatcttttttaataaagtcaatagtttcacaaaaaatttgaaatagattagcttttggttatacaaagtacagtatttcataatttttatctcttctgtatttgtggctgcatagcttttctcagttgtaattatattttcttctttctggattcgatttgtcaatcattcatatattttatagttttctcaaataactctctttttgatacaatgcatatcatatctatttgtgaatttcccaattaactaattctaccatcaccctaattatatcattacccctattacctttaagtctaacttttctaaagttttaaaaatgttttattttttcctttccaaataacaaaatatttatttatttatttatttatttatttatttatttatttatttattgtggtggagtcttgctctgtcacccaggctggaatgcagtagtggcacaaccgtggctcgctgcaacctccacctcctgggttcatgcgattctcctgtctcagcctcccaagtagctgggattataccatgcttggctaatttttgtacttttgtagtagaaatgaggtttcaccatgttagcccggctggtctcaaactcctgacctcaaatgaacttcccaccttggcctcccaaagtgctgggattacaggcgtgagccaccaaacccagcccaaaataatgaaattattttaatgttatgaattacatctgaaaacaagtttgattaatacttacatatttgagttatgtaattttctcactgtcattttctttaaaagatactatcttgcatttgtattcttcattgatcaggagagtgttttccatttcggagtgatctagggctctgcttcaatgtttactattaatattaaatcctagtttctttgggtttgagtaggagaatgaggtctgcttatttcagctttgaaaaattagttgattttttgcgatctaccatataatcctgtttttataaatgtttcatgaatgttttaagaggtacagcctttttttcctacagcattctgtatattatctgttattttctgtgtgtatggttaataatctagtaattgcaattgtactactgaaattttcatcttgaaagacaacatggcataatggaaagaatgttttagagtgaaggtaaatcagggttcaaaactgaattttattacaattagtggcataatcttacagaggtcacctaatatctgaacctcccttatgccttattaaaacagggacatcaattaatacctaccttcggccgggcgaggggcctcacgcctgaaaccccagcactttgggaggccgaggcaggaggatcatttgtggtcaggagttcaagaccagcctgaccaacatggtgaaaccccgtctccactaaacatacaaaaaaaaaaaagtatagccaggagtggtagtgtgagcccctagtcccagctactcacgagcctgaggcaggagaatcactcgaacttgggaggcagaggttgcagtgagccgagattgcaccactgcactctatcctgggtgacagagtgagactgcatctcaaaaaaaaaaaaaagaaatagacttggcccgggtgctcacacctgtaatcccagcactttggcagaccgaggcaggtggatcacctgaggtcaggagttcgagaccagcctgaccagcgtggtgaaaccccatccctactaaaaacacaaaaaatagccgggcgtggtggcgcatgcctgtaatcccagctactcaggaggctgaggcaggagaatcgcttgaacctgggaggcaggggttgcagtgagccaagatggtgccactgcactccagactgggcaacaagagtgaaatttcatctctaaataaataaatcctaccttattgctatcataagtaaaatagcttaacaatgtgcctgccctatagttcatcacagtgagtgatgttattaatatttgcttatttgatctgctagtgattgatagcacatgaaagtcttccctttcttagctccaaaaaaaatgtctcattactataccttctagtattctcggatccttttgtctttctctcttgtaaagttcaagtctccaatttctgtgtttcatgtattatctttctctcatcattttacctcttttttattttccctgtctagactaggttggggctgtaggttattgatgtgattatctgtgctgtggctgttgctatttattatgcttctggaattgttctccccccacccaccaggtaatatgatatcatattttctggctgggtgcggtggctcacaccgataatcccagcactttaggaggccaaggtgggaggattgcttgaacctggaagttctagagcagcctgagtaacatagcaagaccctgtatctacaaaaaaataaaagtagctgggcatggtggtgtgcacctgtagttctagctacttgggaggctgaagtgggaggattgcttgggccgaaaatgttgaggtggctgcagagagctataatcatggcacggcactgcactccagcctgggcaacacagtgagaccctgtcgaaagaaagagaaggaaggaaggaaaaaaggaaggaggaagggagggaaaaaggcagggaggaaaggaaggaaggaggcagagaagaaaggaaggaaagaagagggaaaaaggaaagaagggaggaagaaggggaggcagacaaggaaggagggaagggagggaggaaaaggaaggaaattatatttttcagaaagcacttatatttacctctataaaattaatatactaatatgctattttaagtaacataacagaggagtatatgaagtctaagtgtataagtaaaaagttcatatcatgcagatttcaacttttccattacacaatggcttctctttctgcccttcccaggtcctgtgtcctaccccttccctgttatttctttatcatgtcacatgcaggtgctgctctactcacacatggcggcccttataatgcatacccaaaaaacaaattgaaaaggatgattaagaagagatatgggctgggtgtggtggctcacgcctgtaatcccagcatttttggaggccgaggcgggtggatcacttgagctcaagagttcaagtcctgcctggccaacagggtgaaacctggtctctactaaaatacaaaaattagccgggtgcgatggcatacacctgtactcccagctacttgggaggttgaggcaggggaatcgcttgaacctgggaggcggaggttgcagtgagccaagatcatgccactgcactccagcctgggtgactgagcaagactctgtctcaaaaaaaaaaaaaaaagaagaagaagaagaagcaatatgaatgaatgaagcctctgaaatctgtgcccacactgtgttagatgcttatgagcatctcttactttgctcacatcatggagaccactgtcccagacaatatccaatttccctgcattttccttctgcagcactttcccgtttttaacacacacacccttgtgagtccttggttgtctctgtttgcagctgcactcttaatttcctagagggcagtgcccacatgccccctgttcactgcagtatccccaaggccgagcacgatggctgccacgtcatgggtttgggtaaatatttattgacatgagttagaagttgcagttccctgccagcgcgtcccaggtaggctttgactttgctggtgcattgtcattgttcttgtttgttctcctcactgaagccaggctcattttcttttctattttatcttattgagacaaggttttgctccgttactctgactgcggtgcagtggtgtgatcatagctcagtgcagtctctaagtcctgggctcaagcaatcctcttgcctcagcctcccaagtagctgggactacaggcactcaccaccacacccagctaattttttatttgttttgtagagatggggtcttgctatgttgtccaggctggtctcaaactcccagcctctcacctcgatctcccaaagtgctgaaattacaggtagccacgactctcagcctccttccgttcctgtttcagcctcttgtcttttcatcttcgtatgtctatttgtggacaaatcttctttgtggaaggctttcattggccatatctaacacaaagcaggtgtttcttaacctttcttctgtctctgatagtgaataatttggaggagttaattttgtttttgtacattaaagggcagtgcttcccttctctgctggattaaaccttacgtttccccactagttttcatttttatttatttatttttttgagacagtttcactctgttgtccaggctagagtgtagcagcacaatcttggctcactgcagccttgacttccctgggctcaggtgattttgccacctcagctttctgagtacctgtgactataggcacgtgccaccgtgcccagctaatgtttatatttcttgtagagacagggttttgctagatttttgtatttcttgtagagataggattttgctaggttgcccagactggtctcagactcctgggctcatgcaattctcagcctcccagagtgctgggattataggtgtgagctaccgcacctggccttagttttcaatcctttttttttttttttttttttttttttttaagagggagtctcgctctgttgcccaggctggagtacaatggcgtgatctcggctcactgcaacctctgcctcctgggttcaagtgatacttctgcctcagcctcctgagtagctgagattacaggcacctgccaacacccagctaatttttgtatttttagtagagacggggtttcaccatgttggccatgctggtctcaaactcctgacctcaggtgatccacctgcctctgcctcccaaagtgttgggattacaggcatgagccaccacacccagcctctctacaaaaaaattaaaaaatgaattaggcatggtggtgtgtgcctgtagtctcagctactcaggaggttgaggcaggagaattgccttagcctcggaattggaagctgcagctgcagtgagctatgattgtgccactgcactccggcctgggcaagaaaaagagaccttgtctccaaaaaaagaaggaaactggagcctgaggcttccacctcagctttctgagtacctgtgactgtcggcatgtacccccatgcccagcttatttttgtatttcttatagagacagggttttgctgggttgcccaggctggtctcaaactcctgggctcaagcaattctcctgcctcagcctcccaaagtgctgggattataggggtgagctcctgcacctggccttagttctgaatccttttttttttttttttttttgagagggagtctcgctgttgcccaggctggagtgcaatggcacgatctcagctcactgcaacctctgcctcccaggttcgagtgattcttctgccttagcctcccgagtagcaggattacaggcaactgccaccacacccagctaatttttgtatttttagtagagacagggtttcaccatgttggccaggctggtatcaaactcctgacctcaggtgatccacccacctctgcctcccaaagtgttgggattacaggtgtgagccaccacacctggtctctctacgaaaaaattaaaaaatgaatcaggcatggtgttgtgtgcctgtagtcccagctacttaggaggctgaggcaggagaattgccttagccttggaattggaagctgcagtcagctgtgattgtgtcactgcactccagcctgggcaacagaaagagaccctgtctccaaaaaaagaaaaggaagaaaacaggagagcctgtggagggagctgcctgtggctctcactcattgcattacttgcaggtgctgaaacttcttcccatgtaatatgctggggttgttcctgcaattcaagatcaaaacagaggcaccaggaagggagaggaaatggataaaagggaagggggacaagatgccagacttcctagtaatccaagcacacatagtcaggagctggttgtctgggtgcctggattttgcagacctgggtctcccagcttggagcaggcagcacatgctgttcacgactcttcctaccctttcctggcaggtgctttctagtagtgcctgcagagaccaccagctttatttctccatccgcttcactggagccatggtgagtgtacgtttccccagattcattcaaatggatgactatcttcagcttctaggaccgctgtgactttgtgtctttttctagttgcatggagacttccgtgagaagttgagcaaaaacacatcagaaattggtatctccttgcctcttaatcctgaagtcaagattattctgcagtcattgcatccatattctcaaaatgcctaacatatttcagatcagaagttttaggctgtagctgggtgcagtggctcacgcctctaatcccattgctttgggaggctgaggtgggaggattgcttgaggccaggaggtggagatcggcctggggaacatagtgagaccccatctcttcgaataactaaataaataaaaaattagccaggcatggtggcgcacccctgtagtcctggctactcaggaacctgaagcaggaggttcacttgaacccaggagttcgagcctgcaatgagctgtgattgtatcactgcattctagcctgggtgacagagcaacactctgcctcaaaaaaaaaaaaaaaaaaaaaaaaaaaaaagttttaagcggaaattattctctgaaggttaaaaaataccctgcaaccgtcggagtagatagaaggggaggtttgatgcaattgagaggcctgtttctctcttgcctggataatttctcttccatatggatccctgagagaggtgtgtgtataggagaagttggaatgggaaataaagtccccctttgtatctgccttgctcatcccccatctccccatgcagaaaagaagacaggggtgaggtggcttggcctactatgaggaggccggctctggatgaacctaccacatagatgagaaacatgaccagaaatgggcttcagctctgagcacaaactttgagcacatcctgagagccaacccaatctgatttgctcctcctgttctgctatttggaggagaggggagagagggggcaatagcagcactaggaagtgcaatcagcctaccccaactctcatattcaacctgatgtggtttggttgtgtccccacccaaatctcatcttgaattcccgcgtgttgtgggagggacccggtgggaggtaattgaatcatggtgggggtggggggactttcctatgctgttcttgtaatagtgaagaagtctcacaagatctgatggttttaaaaagaggtgttcctctacacaagccctctcctttgcctgccaacatccatgtaacttgctcctcctttgccttccgccatgattgtgaggcctccccagccatgtggaactgtaagtccaattaaacttctttcttttgtaaattgcccagtctcatgtgtgtctttatcagcagcatgaaaacgaactaatacaacccctttacctcttttttatttgagagacagggtctcactctgttgtctagaccggacaactgcagcctgaaactcctgggctcaagcgatccttctgcctcgacctccagagtggctgggaccaaagcatagtgacatcatgcctggccaagttttttttattttttgtaaagatgaggtctggctatgttgtccaagctggtttcaaactcctggcctcaagcaatcttcccagctcagcctcacaacttattgggattataggcatgagccaccatgcctggcttgattttcttactctgctatggttaactgatatttttcattctaatgtaaagtgtgcataaaagcatttttttctatttttattgttctgcattatgtaatacatatacaaactttgtgcttgttgttctgctcccctgggaaatgggcttcctgggggttctggactgctgaaggcaatgaacctctctgggttgtccagacctttgttttactttgaccagctgtgtgaggataaggtagttcaggaactaggagagcctgctgaatgtaaaattccatgaacagaagcaagagaatgacgagactgtgctagttctttcagaataacagcagcacccttgcactgcacagagttaaacatcccagatctggaaggaccctaccttgtgtcaccagcagctgcaagatctatattagggcctctgaaccacgagaagccatgcatctattcctgctctaggtcgaaatgtttatttctataaatttttgtggccttggctgaatgactcaggaactgagagtgagagtgggggtgtgtgcagaagtgttggcctagcaagatatccttaggatggcacatttgcaaggttggcccttagctggtttctggagaattggagttttggaggggtcccaccattcctaaaacttttaagagtggttcatcaaggccaaactgtttgttcaaacaatatggtttatgctaagcaccctttttccttttgggagtcttatttatttatttttaagtggtaaagtctcactctggtgcccaggctggagtgcagtgacacaatcagagttcactgcagcctcaatctgttggcctcaagcaatcctgcagcctcagcctcccaaagtgctggggttatacgtacgtgtgatccactgctcctgcccctgtttgagagtcttgaatttgagtacatgccaggcagagagtgcctgcatgaccagctcccaatgaaaaccttggacattcattctcaaatgaactttcctggtgagcagcatttcacatctattgccgctactcgttgttaggggagtgaagcatgtcctgtggatgccactgggagaggattctgaaatcttgagcctggtttcctctagattttgccccacactctggatccttcagaagattgtgtgttgtattctttctccatggtaaatcatagctacacatacaactgtatgctcagtcttgggaggacttgtaccaaactattgaacatggtaatgggtcttgggggttcctccaacacatggcccacccacctaacgtgggttaggtgggttacactggacaatttaaccttaatttctccaatgcataacccatctgaaagccttcagtccccttcaaaccaagttgctactgctaagtcccttttataaaaattctggtgctgctgtcaggacaagaacatggtttttgccaccttgctactctgtattagtttgttctcatgctgctaataaagacatacccgagagactaggtaatttataaaggaaatagctttaatggactcatagttccacatggctggggaggcctcacaatcacggcagaaggcaaggaggagcaaagccacgtcttacatggtggcaggcaaagaaggagaggccatgtgcaggggaactcccctttatcggatcatcagatctcatgagacttattcactgttttgagaacagcacgagaaagacccacccccatgatccaattacctcccactgggtccctcccatgacacgtgggaattacgggagctacaattcaagatgagatttgcgccaggtgtggtggctcacacctgtaatcccagcactttgggaggctgaggtgggcagatcacctgaggtcaggagtttgagaccagcttggccaacatgatgaaacgctgtctctactaaaaatacaaaaattagctgagtatggtggtgtgcacctgttatcccagctacttgggaggctgaggcaggagaattgcttgaacccaggaggcagagggtgcagtgagccgaaatcgtaccactgcactctagcctgggcaacagagccagatgctgtctcaaaaataaaaaaaataaaaaaaatttgggcggggacagggacacagccaaaatatatcacacccccatcccctcactccagttatcagccccacagtgtccctttctcagtcttcatcctacttggccctctgtggcattgaacattactagagactaaccacctgcccttgattggaggtgtcccttgatctctcaggcacatgcctctctcttggttctcttctcagactattttgttcccattgtcctttgtctcctgcctcttatgtagagtgcaacaggatatcaaaagggcactcttttgcctcaattttaggccataaagctgaagaataatacagtagatgccaagttttcctcctagaagtacatgctagaccaccctcaagctaagatggcatcagctctgctgccactatcccattgttcttctctatggctcagtgtgcttgggctgctacaccaagataccacagacctggtggcttcatcagcagaaatttgtttatttttttgtagttctgaaggctgaaagcccaacctcaagatgctggtttggttggtttctactgaagcctctcttcctgtcttgcacatgaccactttttgcagttctgaaggctggaagcccaacctcaagatgctggttgggttggtttctactgaggcctctctccttggtttgcacatggccacgttttatcagtgccctcacttggacattttctctgcgcatgtgtgcatatggattagggctccatagttatgagacaatttaaccttaatttcttccttaaaggccttgtctccaaatacaaccatattgggaattaacctatcaactttgatgggacccaattcagtccataacactttttaaatttaattcaactgtatttaattaatttattttttgagacagggtctttctctgttgcccatactggggtgcagtggcatgatcatagcccactacagccacaacttcccaggatcaagcgatcttcctgtctcagccttctgagtagctgggactaaaagcacacaccatcacagctggctatttttttttttttattgtaatttttgtaaggatgagctctcactatgttgcccaggcaggtctcaaactcctgggctcaagggatcctcctgcctcagcctctgaaagtgatgagattacaagcatgaaccacccatgcccagcctcataacactttttaagaggttgacattaaaggattaggcaaaagaatttccttgggaaatagttgaattttttcctaaccttctcagggtggggaaggggtgttttctcattcaatttgagctaaaggtgtttcctaagagccatttgtagagattgacttgtgattgctgcagtataaagcataaaggcagcttatgtttcagccacctgcaaaaagtttaaaggcctgggctggagctggagctgctgttgagtttagtaaccaagcagagcaggagagggctggctttggaagagctgccatctcaatgacacatggggcaatggaggagcctgcttgggggggtcttcaggacctcctagagtgctaatgttgccccagaggagggagagaccttcagaagcccagaggtttggggaggacattttcagtagccaaaagggtgagaggcctgggcccccttttcccttactcctccttctaagcctgtccaactatggtgtggctagaaaccacagctgcacagtggggaaggaggtggactcaataagagtggtggtggtggtgggggagaccctgatctattcctcttccccactctaggtttactagactgggtcaaacccaagtcaaaagaaggaaggtgttttctttcaaaggaaggaagtctgtaatgtgattagtagcctgcacggaatcttttattatctaaaagttactggatgacttttgattccttaagagtttataacaaagcaatgggaccagcccagtactctctccagggaaagatatgagacagggaagctcgaacagggagttgtgagaaagagcaaagtgtttctgcttgcatcctgtggagtctagctcatccaacacgccacctacatagctgctcctcaagccctttgctgagtcctcttctcttccctgccttggtcctttccttcctttgctcttgatgagttcatctggctagatacgaacaactgaattcactgtttaatttttaaattttatttactttttgaacaggtaaaaagtcatatggttcaaatatccaaaattgtgaaaagatatttaaggttaggcagggtggctcacacctgtagttctagctcatagtgttacaggaaaggggtcctgatccagaccccaagagatggttcttggatctcacttaagaaagattgtggggtgagtccatagagtaaagtgaaagcaagtttattaggaaagtaaaggaataaaagaacggctactccataggcagagcagccatgagggctgctggttgcccatttttatggttatttcttgatgatacgctaaaccaggggtggattatttatgcctcccctttttagaccctatagggtaacttcttgatgttgccatgacatttgtaaactgtcatggcactggtgggagtgtagcagtgaggaggaccagaggtcactctcgttgccatcttggttttggtgggctttggctggtttctttactgcaatctgttttatcagcaaggtctttatgacctgtatcttgtgccgacctcctatttcatcctgtgacttagaatgcctcaccatctggaaatgcagcacagagggtttcagccttattttacccagctcctattcaagatggagttgctctggttcaaacacctctgacactagcactctgggagactgaggtgggagggtggcttgaggtcaggagttcaaagttacagtgagctgtgatcacaccactgcactccagcctgggtgacagaacaaggccctatctcaaaaaagaaaaaaaaaaaaatagatactaggttggtgcaaaagtaattgcagtttttgccatgctgatgtaatgggaattctggagtccatggagacctgaaacttccaggagaagctttgggggtggggtaaaggcagctccccattccccacctacaacactgtacttgtgttccaggaagctgtgtatgcattccaggagtagcttgcacacaatttgcgagactcggttaaataaaaacatcctgttctccaaatatcagggacgtgtgttctgaccactgatcagtggttctgactacagaggtgcagacaaagaggctggaagccattggtggtgcacctggccccctattgcaagccccttcccctctggttgaagttgctttcaggggattttaaggtccagtatcctgttcctccatctcgccttccccaacttctccacttttattttccccctgtggggagccagacattaaggagtgggacattcaaaagcaattgcctctacaaggaacgctagaaagtgactacacaggcccagggaaatgtacaggcacagaaaagacctgagaagacattcagtttagtcagattgatcattggcatagagacaagatattcaggcttgggtggtaaagacagctccccattccccacccacaaccctgtactagtgtttcaggaagctgtgtatgcattccaggagtagcttgcacacagtttccaagaactaggttaaataaaaacatcctgtcctcgaaatatcagggatctgtgttctggtcactgatgattgcagtgtttccttcctctgaaccttgatgagttcatctggctggatacaaacaactgaattcattgtttagtctttacattttatttattttttaaacaggtaataaatgatatggttcgactatcaaaaattatgaaaggaggctgggtgcaatagctcatgcctgtaatcccagcactttgggaggccgaggcgggtggatcacaaggtcaggagatggagaccatcctggctaacacagtgaaaccccatctctactaaaaatacaaaaaaattagctgcggtggtagcaggcacctgtggtcccagctactcgggaggctgaggcaggataatagtgcgaacccaggaggtggggcttgcagtgagccgagattgcgccattgcactccagcctgggtgacagtgcgagactgcgtctcaaaaaaaaaaaattatgaaaagatatttaaggctaggcagggtggctcacacctatagtcctagctcctagcactttgggaggatggcttgaggccaggagtttgagtttacagtgagctgtgatcacaccactgcactccagcctgggcaacaaccaaaacagtaaacaaaaactaaaacaatacaagtaaatgaaaacaaataaaaaatgacaaaaataataacaaaaaataaatccttgggagaggggagaatctgatttccagagataccacttattacattaacatatccagttttcagcaaaaaaaaaatcacaaagcataaaagaaacaagaaagaatggcccattcaaaggaaaaaaaaataagctgttcctgaaaaagacctgatagcagatcgaatacacaaagaataaagaaagacattgagaaagtcaagaaaataattttgaagtaagtttatatcagtaaagagatagaaaacctaaaatgaaacataagagaaattctaaagccaaaaagtataataatggaaataaaaactcactagaagggttcaaacaggcagaaggaacaatcagtaaacttgaagataggacaaaggaaattaccaagactggggaaatgaaagaaaaaagattgaaggaacgtgaacaaaacctaaggaatcgtgtccatcaagtggaccaattgacctattgtgggagtcccagaggaagagaagataggggagggagcagagggaatatttgaagaaagaatggttgaacacttcctaaatttgatgaaaaatattaaacattcaaggagattgacaatatccaggtaagatgaactcaaagagacccacagcaagacacattatcagctttcaaaagacaaagacaaagagaatctttgtagccgtaagagagaggtgtctcatcacatatgagattgtcagtaagattgtcagcatgtttctcaccagaaactttggatgccagaaggcagtgggctgatatgttcaaaatgataaaagaaaaaaatacctgtcaatcaagaatggaatatccagcaaaactgtccttcaaaggtgagggagaaattaagacatttttagataaacaaaaatctgagggagtttgttatgactagacttgccctgcaacagaggctaaggagagtccttcaggctgaaatttacggacactagacagtaacttgaagccatatgaagcaataaagatcacaataaaggtgcaattatgtgggcaatcataaaagctaatattattgtaacattggtttgtaactctacattttgttttctacataatttaagacattaatgcgttttcaaaaattactagtttgtggtttgggccatgtaatgtataaagaggtaattttgtgacatcaacaattgaaaggagtgggaatggaaatgtaaaggagtagtatttttgtatgttattgcagttaagctggtataaatccaaattagagtgtataactttagtatattaaatgtaatccccatggtaactacaaagaaaatagatataaaatatacacaaaaaggaaatgagaaaggaatttaaatatttcactacaaaaagatcaactacacacaaaagaatacagcaatgcagaaaatgaggaaccaaaagccttaaggcatgtggaaacaaataggaaaatgacagaagtaagttcctccttattagtctaaaaaaggaaggaaatgctggcatatgctacaacatggatgaaccttgagggactttatgcatgaaataagccagacacaaaaaggacatgattctacttgcatgagatacttggagtagtcaaaatccgagagaaagtagaatggtggtcatcaggggctggagggtagggggaatgaggagctatggtttcatgggtgggggtttcagttttgcaagaagaaaagaattcagaggatggatggtggtggtaatggttacacaacattatgaatgcatttaatactagacctgcacacctaaaaatggttgtgatggtacattttatattatgtatattttactaaaagaaaaaagaaggagctgtcatgagaacatgctctactattcctatgccccacctgccagacgtgccaatgaataaattgctattattagtttttcgggagtgggtacatgtctggatatttttatataaatacttatgcagagaaatcagactatatattctccttgacctccccatttttttaaccaaattgtagcatactaaaatacagttctgtaccttgcttcttcaacttgagaagctatcttgaagatcttagggatcttcctatagatcctggagacttttttttttttttttttttttttgagacagagtctcactctgtcattctgtcgcccaggctgaagtgcattggcatgatcacagctcaccacaatctccgcctcccaggttcaagcgattctcatgccttagcctcctgagtagctggaattacaggcaagcaccaccatgcctggctaatttttgtgttttagtagatggggtttgccatcttggccaggctggtctcgatctcctagcctcaagtgatctgtctgatcggcctcccaaagtgttgagattacaggggtgagccaccgttcccgggcacatcctggagactttcaaatccacatttttttagctgtcaggcactccttgacaccatcctgcctgcaccttgaaaccagcatttccccagtacgtcctcctcctgacttctttgttgttcctagtttcttttcttttctttttttttttttttttgagacagagtcttgctctgtcacccaggctggagtgcagtggcacaatctcggctcactgcaagctccgcctcctgggttcacgccattctcgtgcctcagcctccccagtagctgggactacaggcgcccgccaccacgcccagctaatttttttgtatttttagtagagacggggttccaccgtgttagccaggatggtctcaatctcctgaccttgtgatacgcccacctcggcctcccaaagtgctgggattacaggcgtgagccaccgcacctggcctgttgttcctaattagtttcatggtccctttggtgtcgcaaaccagacacctcagcatcactcttgcctcctgcccttccagtcagttgccatgtctcgttagttccatctgaaatgcccttttcttttatccagacttctccaatccccatcctccacactggctgccttccctattgtcttaactaagaccctttccccagtcagctctaccccaccaagtctaaccttcatactgtccccagattgatctttggtgagcaaagttctggcgctttcatacccaagcctgggcaggttctactgactctgcatcgaagatgagcccctcagcctgccttgaccttctgggcccagcttgtcctgctctcttcctatggggatcctctatccagcatgaagggtggtcggtcaccttccctccttcctggcatcctcaccattgctcaggccactcagcttatctccctttgcaattcattagaatccttccctcttttaaaggctcactgcaaaatcatggaaaatgacctgtctggaccctgcgttcctgactttgtcctgccttaacacaatgcttttaggtcaattatagcactcccttcattctgccttgagtaatggattgcaagcccctggaagctaagctgcgccttatgctttggagatttcatcaactaatttgaatggagtctcagatagacattttttcttcttgttaccctttgaagcccacccacttttcctgtatattcctctcctcccttttattttgcagtgatttttttaaggattattttacctccttatgagaattttggctggttggtcttaatgaatgttgtacagtcctggcactcctgcagcttcctgccctagttcaagttcattactttgactcacatagcagtggggaaaccacgagacacagtccttggcaggctagctttctgtgcttcttgctaagtggatcatgatatttggaagctagagaagggaaaatgaggcctggtctgagtgaattacattctttcttcctgcagctacttgctcattcaagagtgataaaagaatttaatcaaagcttttgcatttaggacctcctgcattccatgaaaggttgcagatctaggaagagactcaccattgtcttttgggggcatgtgattctgtaatggcagtttgatgggaccctgcagggcctgaacaggttttgttcatcagaccaattcttttctggtggaagagacttcagacgtgtgcagggttctctgtgaacgacctgtatcccctccctgggaatggagcacccatagagaattactaagatcctgactgcagacaaagaggcgatttaaggagcatctgttttgacaattgccatttgcattaaagctcctgatagctatctctcccaatttcccactaactttcttcctaaacacccagataggaaaacatactataactctcaaactttgaaaagagcttgagatcctgtgatcctatgccaggaccaagggctggggtctctgatatcaagggaaggcagtacaatacgggggttaataccagggttcttgtcgggtgcagtggatcacgcttgtaatcccagtgctttgggaagctgaggtgggaggatcacatgaggccaggagttcaagactagcctgggcaacatagtgagaccctgtctctacaaaaaatttaaaaattagccaggagtagctgggcgcggtggctcatgcctgtaatcccagcactttgggaggccaaggcgggcggatcacgaggtcaggagatcgagaccacgatgaaaccccatctctgctaaaaatacaaaaaattagctgggcgcagtggtgggcgcctgtagtcccagctactcaggaggctgaggcaggagaatggcgtgaacccaggaggcagagcttgcagtgagctgagatcgtgccactgcactccagcctgggtgacagagtgagactctgtctcaaaaaaaaaaaaaaaaaaaaaaaagccaggagccaggtgtggtggctcacgcctgtaatcccagcactttgggaggtggaggagggcggacggatcacctgaagtcaggagtttgagaccagcctggccaacatggcaaaaccctgtctttactaaaaatacaaaaaatgagctgggcatggtggtgggtgcctgtaatcacagctacttgggaggctgaggcaggagaatcacttgaacccggaaggcggaggttgcgatcagccaagatcatgccattgcacttcagcctggatgacagagcgagtttctgtctcaaaaaaaaaaaaaaaaaaaaaaaaattagccaggcgtggtggcacataactgtggtcctagctactcgtgaggctgaggtgggaagatcactcgaacccaggagttcaaagctgcagtgagctatgattgcaccactgcacttctgggtgacagagtgagatcctgtctctagcaaaacagaaaacaaaacaattaagattctgagctgagcccccactctgcctcatggtagctgcatggccttgatacagttattcttaacctctttttttctaagttatctcattgataagatgtggaaggggagaacctatttatagtgttggcatggaattcaacaagggaatacatgtaaagccctgagctcagtgcctggcacatagcaagtgttaaataagtagttcctattatttattattactctctgaaatgatgaagaatggcctctggtggctgacctgagatgcaagagctagaccacagggagccatttagatttcagtttgactctgtgtacctggtcgccatagcactcgcttggtaagaaaagctgggatcaggagacagtgatccagacagaccatgtcagtgagtgaccttttgaaaggtcacaaaaagcacaggcagactgctggggctggaatctcagctctactccctgcgtaagcttctgcaagctactgaacctctttgagcctcagttttctcatttgtcaaatgggcagcaggaagatgtaaatgaattagtatatgtcccagcactttgggaggcggtggcaggtagattgcttgaggccagcctgggcaacatagcaagaccttgtctctgaaaaaattttaaaagattggccaagtgtgatggcatgctcctgtagttccaggtactccagaagctgaggcaggaggatcccttcagccgaggagtttggggctgcagtgagctatgatggcaccactgcactccagcctaggtgacagagcaagaccctgcctctaagaaaaaaaaaaaaattgtgtgggtattttaaaaaaccatgtccaccacgttgtgcgtgcccagtaaatgttagatattattatgattatcaggtttcctggaccttgcttcagcctggcagcttgggagtggtttttagggacttagtgtaaaacctacctctgagattctatttgtttccgttcccctaaggttgagggtgtgggggcatagggatcagacctctgggtacaatgctgataacttttggggggtattcccagccctgtttgtctgttaaattaaaatctggtaaagaggtcatttctgtagtctaaatctgaatgtttatgttaccagtagggttggtatagaattgtagattagagggaagagtcttcatttactgaaggtctgcagaaaatgtgctgtgtccttacatacttaggaaccagagctgagaaatatcgggagacagctggagatatgggggacctatcctgattgttcctccaaccatgggcctggagacatccccctttgctcattgagtaacaaagagagtgcatgagaaaagaagactgttttcccaatactctaacgctcaagacaaaatataccaaagtgtgggtttttctccctcaccaagaaattccccaattatctgcaaacactggactggatgtcctacaattaaattgaattccgttactatctgttactatctatctggagttaacattatttgaggagcacctgtttagacaatttccatttgcatcaggtccctcaggtcaagggctcagtcccacaagattgctcccacttaggacaccatttcaaagtccacgtggccacctgtgcttctgaccataaatcagaggttccctccttgggttcattcatttactagagcagttcacataactcaggaaagcactttactaattattacccatttgttagaaaagaatacaactcagggaaaggcagagaggcgtaaggtaatgggagtggtacatgcagcttccacgccctctctgagagctccatcctcccagcatctccatgtgttcaccaacctgaaaactgtctgaacctcatacattagggatttttatgcagatttcatcatgtgcgcctgattgattatgaacctagtcttcagctcctctttcctccctggaggttggggagatggcactgaaatttccaaggttctaatcatggtttggtgtttctggtgatcatctcccactggaagcccaccaagaagtgcttcattagaacaaaagacattcctatcacccagggaattccaaaggatttaggagttctggccaggaaatggggtcaaagatcaaatattggccaggcacggtggctcacacctgtaatcccagcactttgggaggctgaggtgggcggatcacgaggtcagaagattggctaatcttcactggctaatacagtgaaaccccatctctaccaaaaatacaaacaattcgctgggtgtggtggtgggctactcaggaggctgaggcaggagaatggcgtgaacccgggaggcggagcttgcagtgagctgagatcgtgccactgcactccagcctgggcaacagagtgagactctgtctcaaaaagaaaaaaaaagaccaaatattagaacaaaagatgctctttgcaactctattacttagggaattatcagtgttttatgagctgtgtaccaggaaacagagacaaagatttctatagctatatctgtctgtctatctgtatgtatatatttgagatggagtcttgctctttcacccaggctggaggccaatggcatcatctcagctcactgcaacctccacctcccagacttaagcgattctcctgcctcagcctaccaagtagctgggattacaggtttgtaccaccacacccagctaatttttgtatttttggtagacatagggtttcaccatgttggccaggctggtctcaaactcctgacctcaagtgacccacccatctcggcctcccaaagtgttgggattacagcatgagccactgcgcctggccaatatgcatttcttattataaatcaaagtatcacaagcgaaaaacatacattggccaatctggaattccaaacgtcctctcctaaatgactagaagcaaatatttccatgatctgtacctcttctgccaagtcacgtgtactccacgccatagttggccctgcccataggatcctgagtgcccttctccatcgcttcttctctggccaacaatttggaatagcaaatgagctgctccctttgccaggaccaagatgtgtttcagaagcatcatttctgcttgtcagcttttggtctgtagttcccagccaagtgcaccatctgtgagcactgcctggtactgtgatgatttggcccagagctccatgtggacctgtgaaatgcaccagttccaaactgctgcgctccctgcaccctgagtcgaggtttcagaggtgggtggtcttgctcctcttgctaccttgaaggtgcactgttcaaagacagcctcgttctcctggtgctggcaagcatgggttttgccacatctcgtaaactatgaggttcccaagtgggagagaatggtgcccattatatcacggtcaggagcagcctggtgggcatatcttagatcaggtctcatgtgtttttttttttttttttttttttttttgagacggagtctcgctctgtcgcccaggctggagtgcagtggcgcgatctcggctcactgcaagctccgcctcccgggttcacgccattctcctgcctcagcctcccacgtagctgggactacaggcgcccgccaccacgcccggctaatttttttgtgttttttagtagagacggggtttcactgtgttagccaggatggtctcgatctcctgacctcgtgatccgcccacctcggcctcccaaagtgctgggattacaggcgtgagccaccgcgcccggccaggtctcatgtgtttttgtgtgtgtgtgtgtgtgtgtgtgtgtgtgtgtttgtttgtttgttttgagacagggtctcactctgtcaacccaggctggagtgcagtggtgccatcttagctcactgcaacctctgcctcccaggctcaagtgattttcctgcttctgcgtcccacgtagctgggactacaggtgcccgccaccacacctggctaatttttgtatttttagtagagatggggtttcaccatgttgcccaagctggtctcaaactcctggccttaagtgatccaccctcctcggcctcccaaagtgctaggattacaggcatgagccactgcacctggccctcatgatgtctttgcaaaaatagattcgtgtccttgagcttctaagcctctatgaacagttagacctcactgtgggtgcagatagtgagatgatgcccactgctgatagaccgacattccagagggagtacctgggcaaaagaaccacagtacttggggcgtctcctagtccagtgcttcttaaccttcctcttctttttttaaataagcacctcccaagaaccttttcagatatgcatttttctagttgtcccaccctcttgaaattttgtacagatacactgtgtattatgtactgtagccctagaagagccgcaagccattgtaatatctaacattggctaatgttattttgttccctaagaagccattttcaccccattgtgggtgatactgtcactcttgagaatgtatagtttagttcaagactgtttggccatccagccccacctgtgactagtggaggtgatttggggtgagcagagagttactgcacaaatgtaacaagcatgtctatccaagacgtggagccacgtggagttagctttcagaggtgtcaaattctaggtagactgggccattctcctttccctctagctttctacttttcacttttacaaataccagttgagtatctatctgtaggcaaatatcttgttctatattcaagataaatgttgttttattttttctctaaaaatgaagttattaaggtcaggtatggtggctcatgcctgtaatcccagcactttgggaggctgaggaaggaggatcacttgagcccaggagatcaagaccagcctgggcaacatagcaagaccccctctctattttttttttccccagacagagtcttgctctgtcgcccaggctggagtgcagtggtcttaccttggctcactgcaacctctgcctcctgggttcagcgattctcctgcctcagcctcccgaatcgctgggattacaggcacctgccaccagacccagctaattattgtattttttgtagagatggggtttcaccatgttggccagactggtctcgaactcctgacctcaggtgatccacctgcctcggcctcccaaagtgttgggattacaggtgtgagccacctcacccaacccccctctattttgttaagtgcattgttagatccaaaggaaacagcactttacaggatcttgattggtacttcctgtctatatctgggacaagtacaccaggaatgcattatagaggtgatctctctgtatttctggcagcatcgactagtgtgcttttggaagtatttgataattttgaaggcaagatggtaactcgttgcttgaattagctttcttacgattaccagcaagagtgaaattttagacttatcttgttggatgataagataaatcaatttcttctccagaggccaccgactgcccctcttcatttggtggttaaatcctccctttcccattgacttgccacgcctccctaatcctttaggaaattttacctctgctgggatctgttcctggacaatctgttcctggacaatctgttctgaattattggcatcttgatgctcacatctgcttggcattgtgaaataggttttgaatgaatattctttgaaggtgaatgcactctgagagggcattgatttatgtgtgggcatttggacaaactcttgtgtgcagacacctggctgtctgtgctggctgcagccaaggtagggatgtggtgaacttttgatggagttgcccttttgagcagttcagagggtgcagaatgctacactgatgactcctggaggacccaacaatgccttgaaggttcgctcttgtctgttgagttggctcaagtccaccttctgattactgtcagctctagcatgaaagatccagcagatgctgaattgaacaaagaaagaacgagcaagagacatcattcattcattgtacaagtacatactgaatgcctgctttggtgttcaatatacaaagatgtttcagaccaagtccttgaccttgcagaactgacaatcttttgcttgtgagataggcatgcaaatcagtgactgggatataaggttttattttattttattgttttattattattatttttttagatggagtcttgctcttattgcccaggctggagtgcagcagtgcgatcttggctcactgcaacctccgcctcccagattcaagcgattctcctgcctcagcctcccaagtagctgggattacaggcatggacaaccacacccagctaattttgtacttttagtagagacagggtttcaccatgttggtcaggctggtcaagaactcctgacctcaggtcatccacccacctcggccttccaaagtgctgggattacaggcatgagccaccgcacctggccaggatacatggttttaaattctacagtaggtacacatggagttagtaggagagagagaaaaaaagttcgaccagttctgcctaatgagatcaggaacaaaacaaaaagagaacatgacatttcagctccgtcttagagaaagagaattcaccagatagacaagtgagggaaggcatcccggacagagggataggcatacacatgcacgcagaggtgtaaaggagcttgtattttatgcaaaggttggggacaaattgatgcaaaagagatagtgaggcttgaacactatgctgaggtggtatccctattttcagtcaaaggtgctgttcaggccgggcatggtggctcactcctgtaatcccagcactttgagaggccaaggcaggcggatcacttgaggtcaggagtttgaggccagcctgggcaacatggtgaaaccctgtctctactaaaaatacaaaaattagccaggcttggtggcttgctcctgtaatcccagctactctggaggctgaggcatgagaatcacttgaacccaggaggcagaggttgcagtgagccgagatcacgccattgcactccagcctgggcaacagagcaagacaccatctcaaaaacaacaaaaaaagtgctgttcaaatatagaaagcatgatgagatttggtcttggggaattaaactcagaactgcatagaagagactgcgaaggtaagagtgtaaaagccgtgctactcataacagaatcgtagctaggaacattaattcttagaaggattttctcaccttcatggttgaaaagggaactagccattgagtaatgaggaagatacagcaaccacagatacttaagaggtgaaatcaagaaggcttgatgactacatgtatatgtgggtgacaaggatggtggaagagatggggtgaagctgccacttccatcatgtacaactgggcaattcggagtaaaaggagaagcaggggtgaggtataaccatgttaagtgggaagtgatggttggacatttagctagaaatactgtcaaatgtttaggaatatgtggttttggttgtactaataattgccagtttcttgtggtactttcagtcattgaagaacattgaacagttttaagtaatgttaccagctcttcttcattgattgaggtcatgccaagaagaaaagcgtagaggtgtttattgcatcaggtacggtaggtcaagttcagcttgtttgcaactcatatttacatcttctccttgcaggggatggccaggtggattttgatgaattcatgaccattcttggccccaaactggtgtcttcagaaggtcgcgatggttttcttgggaacacgatagacagcatattctggcaggtgagtaagaatattttttttcagactaagtttgacagtaaatgtgtctgagactaacttttgactgaattcttgaacttctatttggcacgtgaagatctcttctgggctgagcgacatatgttccagaacaaagaatcaaaacaactacttttttagggtttggaggagtgaaatatctccccatttttttcttgtagcaatttttttttgcattagggaaaaatgaaattattctactgcacattcacaaaagtctttttcctggggacacttcaaaggggcacactgatattatctgaaccggttctgtgtttgaccccagttccgggatatctttgctgagagaatggcatggttgcctggtacatttggatcccgtcaatatccttgcacttaatgagagagaatggttttgtctaagaatgtgtattcagtgcttctcaattagctcctgtttctatcttgtaaaatctcttaggaaattccaaacatctaacattgtaattattaaagtataatgaaatcatttttatattagttctctactcttaaaatgtgacaattattttatgattataaaatttagggagtgggttatcaatcattattttaaaaaatttgaatcacgtaagttgtctgtcaaattaaattaaattaccagttagacacgtaaaacgccattcagacacagcatgatttttcttttttttaaatttcttttttttttttttttaattttatttattttattttttgttttttcccttcaccaggagatttctctaacctagataagggttgcagttggtgtgtctttctagtcttattcaggtacccatcttgcatagaaccaacaagtatttagtaagaacttacatatgctataatctatcagtgcttgtgggttttacaaaaggcatttaagactcagacctagctatttcacaatttggctggggaagctgaatttggtggctcatgcctgtagttccagtgctttgggaggccaagacaggaggatcgcttgaggccaggagttcaagaccagtctgggtaacatagcgagatcccgtctctgcaaacaatttttaaaattagccaaatgtgatggcgcatgcctgtagtcccagctactcttgaggctgagggaggaagatcgcttgagcccaggagttcaaagctgcagtgagctatgatcacaccactgcactctagcatgggcaacagagcaagaccctgtctcaaacaaacaaacaaaaataataatttggctagggaaacacaattaagagagggaaaacaaacaagtgattaattagtgtgatggtcactagactgtaactccttgaagcacagggcttcagagttgtagctcactctgtgcatgctgtacacagcaagccctcaataactatttgtttcaatagatgaatggaagggcaagaaaggaggaaaatacagtcttgaagggtcagaaaagaatttagggaatgtgacacttgctttgaaccttgaagtatgggtggaattaaatgcaaagaaagaaaagagggcatttcagttctgccatgatgagagtttgaaaaggggttggcatggggaagtcattgaccatgactaagataccgtttgaagggcaagacctcaaaacccactggcagaatggatttagggcctgaagaaacagaagaggtgaggctgattccagagttcccaacttgctgttattggcaggggtcagatcatggagcaacagagaagtcttgtggggttgaatcctcaattggacatgctgagtagaaggtgagggtcaagcagccaagtaaagggaggaagtctatgcacagctgaaatcagttggggctggaacaccggattgagattcatgagagctggtgggtaaaattataggcaaggatgagctcaccgagggaaggtgcataaaagaggatgagcagagagatgggacctggtcccagaggacatccaggatcaggggagagtgagacaggggctcgtgaatcccccactgctgacaggaaaacgccatctccctgaactgttgttaggatccagaacatctccaggaccctactcaccatgcaaggagaatattgcagtgctcatggaaccttcagttatgacttgacacttgcaaggaccaataggtagagtcccctggtggaaataagaaatgaccccagagttcagaagatgaaggaatattgtttcccatctggccatcttttgacccatggaggtccactctgatgatgggccttggcgagttgcttctcccctgggcgtttctccttcttctttctctcattctccatctattctcctgaatgcctttttgcttgttttttgtgtattttagagatagggtttcattccgtcacctaggctggagggtagtgatgcaaccatagctcactgcagccttgaactcctggactcaagtgatcctcccacttcagccttccaagtggctgggaccacaggtgcaagccaccataccctgctatatttttctgtgttttttggtagatatggtgtcttgctatgttgcccaggctggtctcaaactcctagcctcaagcaatcttcctgccttggcctcctaaagtgctgagtttacaggagtgagccatggcacctgagcccctgaatgcttcctactctttacctccatccttagggccaactaaggagaatgttccaaggccttgtgagttctaagcattcttctttctggccctcatctggatgagaaggagctatggctacttaatctacactcctactcctcctgtcttccaggttcatcacagtagagcgtgtacactgcaaggaaatatatctcttacaatatatggactgcctgtagcttaattcagacatgctataatgctcacaaagtctccatgtttttgtcttactcaagattttcttccccactcagggtgaaaagataggctggagaaaggagggaaaattccatcttgaaatatttaaatcaatgctggaagtcacagacttagtggctgtggctttcctctcctgctagtgctcacccagctcagaattttacgactagcaagcaagaacaaaaacatccatcaattctcagtaatcagcctccccttcttccccctgcgactgcctgccccttcagagacagcgtgaaaaaatggtacttaaaacttctacagcattggcttgtttctggaaaagagttcaggttcccagtgcttgggtggtttttcaggtttagaagaaagctgagtgtgtgcatgtgtgtgtgtgcacatatatatacatgtgtgtttccttccttgaagtgattgaagataatatacaaaaaagaagcagaaaggttgctttcccaacacagtgagagcctgtctctaaagcagattgaaaaattagctgggcatggtgttatgcacctgtagtcctagctgctctggagctgaggcaggaggattgcttgaggccaggagtttgaggctgcagtgagctgtgattgtgccactgcactccatcctggctgacagactgagacctgtctcaaaaaataaaacaaaaataaaaaataggaaaagtagcttttcacctccagatatccaggcagaagatattgatcttaggaggtactgatatccttgaaagaagaccatcctacttaagagactctagcaaggcttcccatcagtgacatagtcagttttccgtggaaacagacctgagactacttctagaagggtatatatttgtggtctttggctgcataatacattacaccaaaatctagggccagaaaacaacactaaatattttctatctcacttagtttctgtgggttgggaatttgaaagctggctgagctgggtggttctagctcagggtctctaatccagttgcagccaagatgctggctggagctgtgaccagccttgggcttgactggactggaagatgtgcttcctggtggctcactcacctggctggcaaggtgacgctggtggttgacgggagccctcaggtccctactgcacagaccttgccacaatgctgcttgagtgtcctcctgacatggcagccagtttccctcaaagccagtgatccaggacagtgctaggcaagagcaatgatatcttttatgccctagctatcaagttggacacaatcatttctgcaatattctcttggttacacaggtcatccctattaagtgtgggagagaacagcctcccggtgaatgccaggaggcaggagccattgtggatcactttggaggctagctaccataaagggtaaagattctgtaattggacttcaacttctgatctgacattgctgccccaagccttccattttccccaggcttgggtttcttcctaccttagaggaaacctataaccaaggctattctctgtatcactgagaagcaatcctatcaagcactaggtgccttttcctaataaaatccttcttccaggccagacagggtggcttatgcctataatcccagcacttagggaggccgaggtgggcggatcagttgaggcggggagtttgagaccagcctggccaacatggtgaaacctcatctctactgaaaaaaaaaaatacaaaaaaaaaaaattagctggatatggtggtaatcgcctgtaatcccagctactcaggaggctgaagcatgagaatcatctgattctgggaggtggaggttgcagtgagctgagatcgagccactgcactccagcctgggtgacagagcaagaccctgtctcaaaaataaataaataaataaaataatttttttccagtgctttccttactggtgttctagcctatagtgccaagggtagaataaaatcaaatgggattcagcaaaaacagctatttattggttggtactagtcgcaaaagttatgagcccctggctctttgcaggaaattgattaacagtgaagggggaatatagttggctacaaatgcggcttcctttccggggaggatggtctgagagtcatgccccagggtctccagtcctcccggcatacgctcagccctctgggtgtgagactcttggcagccagttcagaaccgctttcctatgcataagttgtaaagctgtgattgtgttcttagtcttcgttcatcaagcttctgtgtgtttttttgttactgcagtggtatatttgctgaggaaatgtgaaactgtgtatggagtcagccttaggatatggtatatgggaatggcagagaggagaggagggaaggaagggactgagcggggctgagactcaggactggggggtaggcttcctgctcaatgctgcaggttaattgcacctgccaagaagtcaagcacggtcctcagggtccctgcttttccaccatttatttacgccacacatcatgtgcctacttgtatccaagaataagaggcttatgatacagtagatgtccccaagtggcagaggaaagagccctgctattttatcatggtgttttcatgaatttaccccagcagcctttttcattttcttctgcttgacctcaagccccgtgcaaccgtgttctgccatgagtttgcagacagcaagctatagagagcatatgtgaaaggatcatgggagattaaacaggtctgccagtcctgggggccagccaacacttctgttaacctcttttccctctgaagaaacagagaaatgagtcccacacttggtgaggagagctgagctgtttgtgtgtcttacttttgccaccgtgaggttcaagaacacctcggccagagtgacgccgaaaacatctcatgtagaactgggttcctttgctcacatttttaatcttattcacaatcaaaccttattcatgaagacttcactaatttagactttctgttttaagaaatgaaatattcacagtttgtgagcaaatagatctgctcattggatggtgctggtcgtgttggaatgagtccggggctaaaggtcgggagacaagaagcccataatagctccctggtctttttgcatgctcaggacttttgggcaatactcccgagcacacacgaagtccagggagccattctgcaagctggtctttagaatagcttgtttatcccacagctgtgtgcaatgtgcaagacattgtaaattaccctagcctgaaagtgcatagggtactcgttccccaatttggttgggatgaaagtctgtttgccacgctgacttgctttgcctctccctggttatcaatcataggtctgctgctgtccaatcctcactcatctggtgggagaatatgcagcaggtgcagtaaaatacctgcatctactccccagaaacctttccggaaaggctttaccttttgtctctccatcccagttcttgctgtggtctcgtgtctcctgtggctttccatttctgctttggtcctggactctttttttttttttttttttttaatttttgagacagagtctctctctgttgcccaggcaggagtgcagttacatcatctcggctcactgcagcctccatctcccgggttcaagtgattctcatgcttcagcctcccaagtagctgggactacaggtgtgtgccaccatacccagctttttttttttttttttttgtatttttagtaaacacggggttttgccaccttggccaggctggtcttgagctcctggcctcaagtgatccactcaccttggcctcccaaagtgttgggattacaggcatgagccaccgtgcccagcctggtctaggaatcttgatctctgtctcaggtcctcatgcaaaacctagttcttcccagcccaggcccaggcttttgtctgggacattttataagctggtcccaccgtgatggcagagatgggcaggtggtttggttttaaaattactgactttaggcctggcacagtggctcatacctataatcccagcacttcaggaggccaaagcaggagtttaagagcagcccaggcaatgagtgacaccctttctttacaaaaaattcaaaaattagcgaggcatggtggtacatacctgtagttccagctactcgggaggctgaggcaggaggattgcctgagcccaggaggttgaggctgcagtgagctataatcatgccactgcactcttgcctggtcaacagagggagattctgtctcaaaaaataataataataataataaaataaataaaattcttgacccatggacagttgagagcatttgcatttcatggttgtgacatgtgaaggaaatattacatacaaaaagctataatacaatgtgactgcaaatctgttatgcataaaaagactggaaggaaatatattcaatcattgacagtgactttttttttttttttttttgagatggagtctcactccgttgcccaggctggagtgcaggggcgcaatctcagctcactgcaacctccacctcctgggttcaagcaattctcctgcctctgcctcccaagtagctgggattacagacgcccaccaccatacccagctaatttttgtgtttttgttagagacggggtttcaccgtgttggccaggctggtctggaactcctgacctcaggtgatgtgccggcctcagcctcccaaagttctgggattacaggtgtgagccaccgtgcctggcctctcttccattcttaatcatctaatggaaccttaatagttttcagcagtgatgtctatatcaaggcctgctagactgacagcaagccttcattccccacagggatcttaccaagtgtggaaaaatggaatatgggaagcattcatgttaacagtggttctcaaagtgtggttcctggaccagcagcattagtaatacctggaacttgttagaaatgggaattctggcccagcaagtgactcacacctataatcccagcactttaggaggcagaggtgggaggctctcttgagcacaggggttcaagaccagtatgggcaacatagcaaaaccccatctctagaaataataatttaaaaaattagcctggcgtggtggcacatgcctgtagtcccagttattctggaggctgaggtgaggacattgtcggaatccaggcagttgaggctgcagtgagccatgattgcaccacctcactccagcctgggcgacaagagtgagagcctgtctcaaaaagagaaaaaaaaaaaaaaagaaagaaagaaatgcaaactcctgggccccacctattaaattgaatattcaatactgacctgttgaatcagaaactccaggcctatggcccagcaatctgtttctattagccctctgggtgacgtcaacgctggcttgagtttgagatccacttagttacaggattttaatgagcctgacatttgggacaaggcagcgagttagttttactgatctggttctgacccttgcttccttccaggcttggtaatttgggtttttcttttagttatccttattcataagtgtaattgatctttagtctatttaacactataattttaaactgttttgaaaaggtggagaaattacctatcaatatgtagctaatttctaagtaggaaataattttctaagcattggaggcaatggaacaatcaaataatactaacttatactattagattataagaatatttaaaaagctaacaaaggctggacgcagtgtctcacgcctgtaatcccagcactttgggaggctgaggcggaggatcgcttcagcccaggagtttgagaccagcctgggtaacaaagcaagatcctgactctacaaacaaatacaaaaattagccagacatggtgggacatgcctgtagtcccaggtactagggaggctgaggtgggaggatcaatttagcctgggaggtcgaggctgcagggagccatgatcatgccactgcactccagcctagacaacagagcgagaccctgtctcaaaaagtaaacaaacagaaaagctaacaaactggcaaaaatatggcaatttgtagaataaaacacaggtacagaacatttctaaagctatgtgaaacctcttgacaataaatgggataaagagcaatagacaactgatagacatttgaaataaacattaaaacagctcgacctcaccggaaatcttagaaatgttaattaaaatagggattggttaacagttatcttctcagaatggaaaataaatcatgtaatactcaaagttgtcaggagcaagataaaataggcaaactcagctggttgcagtggctcacgcctgtaatcccagcactttgggaagctgaggtgggcggatcacctgaggtcaggagtttgagaccagcctggccaacatggtgaaaccctgtatctactaaaaatacaaaaattagctgggcgtggtggcgcacatctgtagtcccagctacctgggaggctgaggcaggggaatcaccggagcccaggggacggaggctgcagtgagctgagaccaagccactgtactccagcctaggcaatagagtgaaactccatctaaaaaaaaaaaaaaaaaaaagagccaactcatataacactgatagaaatgtaaatagaaagaaatgtatttacaatttctttgtagaaatgtaaatttgtaaatcatacaacttttcagaaaactatttggtgacacttggccataatttttaaagccctataatttaaaatatgttcaaaccctgtgatttaaaataattttctacatttagtaatctaccatataaaatcagtcagagatgtaggaaaatgcaattataaagataaaatattatataattgttagaaataatattttcactttatagtaaatggaaaagccaagatagagatggaatttacagtataattacattaccatcctacatctattatgcccattatattaatctattatgcatccatttatagtcatagaaaaaaatggaaaaaattctgattgtacttattttgactggcacaaaagtgaataattttttctttatacttgtttgtattaggctatacggtctattctgttattattcagtaaagttaacaaaatctcaaattagtctgggcatggtatctcctgtctgtaattccaacacgttgggaggctaagacaggaggatcagttgagcccaggagtttgacaggagcctaggcgacatagtgagactctgtctctaccaaaaataaaaaaattagctgggtgtggtgtcatgcacctgtggtcccaactactggggaggttgaggcaggaggatcacttgagccaaggaggttgaggctgcagtgagccatgatcacgtcactgcactccagcctgggtgacagccagatcctgtctcaaaaaaaaaaaaaaaaaaaaaaaatctcaaattagcaaaattacattatccaacaattgttttcaggggcaaaaacaaaaaggggagaagtgattggaatttaaagcatttctagttcacacgcccatggttatggtaaatggagcacaaagttgatatgagagtataaaagccggccgggtacagtggctcatgcctttaatcccagtgctttgggaggccgaggcaggtggatcacctgaggtcaggagttagagaccagcctgaccattatggtaaaaccctgtctctactaaaaatacaaaaaaatcagccaagcgtggtggcgtgcacctgtaatcccagcaactcaggaggctgagacaggagaattgcttgaaccccggaggcggaggttacagtgagccaagatcacgcccttgcactccagcctgggtgacggaaggggactctgtctcaaaatcaatcaataaataaataaagcctaaaatcaaaattaatgcagctgccagctgccaggaggaaaagaactcactggagaccactgagtggcagctgtcacccaaagccactgtatgaccctctgctgcagaggctgcaggaggcgcaaggcaggactgtcacagatgctgctctccacataccagccttatgtccagttaatatgctgaaaactcatattttgggaaaaagtctgaaatgattttatgatcacaaaaaataaattgattaaatgtaatttttgttttgttttgttttttgagacggagtctcactctgttgccaggctggagtgcagtggcacgacctcggctcactgcaccctccgcctcctgggtcaagtgattctcttgcctcagcctcctgagtagctggcactacaggcacccgccaccacacccagctaatttttgtatttttagtagaaatgggatttcaccatgttggccaggatggtctcaagaggacctcatgatccgcctgcctcggcctcccaaagtgctgggattataggtttgagccaccgtgcccggccgattaaaagtaattttaaaaaattgcttcaaaataacctcatggctggtacttcagcctgtagctgagatgagctgaccagcggctgtaggtggggagaagagaaaaatcactggtcacattatcgggaaagtcctggcaccactggtttcatatctctgttccatagaaccttcccaaattatatttaaaagtattttttttattcaatctacttatcctcaagtgtttaacccatagggtatgatgtgaactgtagacgcccaggaaggtgcagaattttcattgaaagttatctaaatgggctgagtatggtgactcatgcctgtaatcccagcacttggagaggctgagaactgtttgagttcagagttcaagaccagtgtgggcaacatttttttgtctctacaaaaaaaacctaaaaattagctgggtctggtggtgcatacctgtggtcccagctacttgggaggctgaggtgggaggatcactaggatcgtgccactgcactccagcctgggtgtcagagtgagactctctctcaatgaagcaaacaggagagaaaggaaagatgattaggatggatgctatcagaagtagaatcttggccctgaacttgttaaacttcagaggaagcagagaaaggagcgagacaggcatggaagctgatggggacctcttggggtcagtcaggtaaatcccttcaaaccccaaaccagaagtgatcaaaggcaggttcaggagagggaacaggggtcttcctgtgcttcagggatggtgtcctggaggagcctctgaccacggctccaatgctcttgacccacagcgcagagttcagaggttcaacggtgcagccaagagaccagggaggtggctacagccacctgactctctggtcagtgggccctgatccccacactcctgacctcctcccagccagacactggggagcaggccctatactgtcttgtggaggtactgctgtctggttttttgtttttgtttttttttgttttttcctatattgccatggtgaataggattttaattttccttctttcttttttgttttttttcttttttttttgacggaatctcactctgtcgccaggctggagtgcagtggcgccatctcggctcactgcaacctctgcctcccgggttcaagcagttctcctgcctcagcctcccaagtagctgggactacaggtgcgtgccaacacgcccagctaatttttgtatttttagaagagacaaggtttcactgtgttggccaggatggtcttgatctcttgaccccatgatccgcccacctcagcctcccaaagtgctgggattacaggcattagccaccacgcctggctaattttcctttcctttccttttcttttctttttctttttcttttcttttcttttcttttttttttttgagacagggtctcctctgtggctggagcgcagtgacgcgatcttggctcactgcaatctccgcctcctgggttcaagcaatttttctacctcagcttcctgagtagctgggattacagacacgcgccaccacatgctggctaatttttgtatttttagtagagatggagtttcaccatattggtcaggctggtcttgaactcctgaatgcaggtgattcgcccacctcggcctcccaaagtgctgagattacagatgtgagccaccgcacctgattttaatttttcattaaatgtttctaacccctttctgccagtatgatggaaaatggctttggaattttgggcttcatctggctgccttattgaattctctcattagcaagagtctaggtggtttcggctgcagtaactaaatactacagaccaggtagcttataaacaagagaaatgcattgcttacagttctagaaggttctggtgaaggccctctcccagattgcagaatatcaactgatttccttgggtccttttatcccttcatcccttgggataaggggattaatcctttttatgagtctccactttcaggatctaatcagctctcaaagggcccgcttcctaataccatcacaatgggggttaggatttcagtatatgaattttgggaaaacacagacagcagtcatggatttttccagtgattttcttaggctctttatccctgcaatgactttgtctacaaattgcagcaattttgttaccttcctttcagcagtgtatattttatcccatttgtgttgactgacacctatttattactaataaacagtaagggtgatagttgattttaggaaattaacctcttacctactgtattagtctgttttcatgctgctgataaagacatacccgagactgggtaatttataaagtaaaagaggtttaatggacttacgtttccacgtggctggggaggcctcacaatcatggcagaaggtgaaaggcatgtcttacatggtggcagacaagagagaatgagagccaaatgaaagggaaacccgttataaaaccatcagatcttgtaagacttgttcactatcatgagaacagtatgggggaaaccacccctatgattcaatgatctcccccagggatggtccctcccacaacacatgggaatgatgggagcttcaattcaagatgagatttgggtggggacacagccaaaccatatctaacttaccaacattttaaaaaccatgaatatatgatagctttttctcaaatggcctttgaatctataataataggatcatgtgattattcttgtttggacaagatgtgataattaatagatttcctattattaaatcatttttgtattcttagggttaatattagttgtcatggtagcccattttcttaatgcaatttgaatttgtagtgtaagttttgaatttgatttgccatttttattttttattcatatttataaataaaagtgacctatagtttatacaaaattacaagtgtcattgttagttcttgaaacatagttaacctagcatgatgaaattaatttgtttgctttatattattttctgtgatgtataataaattctgtacagtatggaattgatttataactttgactttaggcttgctagttcataaactgcttttttgttttgttctcatttttttgaggtgattatttgataaatattagaagttaattgttcttcagtctattttgaaaacttatattatcttcaggttaccaattcctcaaaattacttagtttattagcatttacttacatataacattgtttaaaaatttatttgaggccgggcacagtggctcacgcctgtaatcctggcacgttgggaggcggaggcgggtggatcacctgaggtcagttgtttgagaccagcctggccaacatggtgaaaccccgtctccactaaaaatacaaaaattagatgggcgtggtggcgggcacctgtaatcccagctacataggaggctgaggcaggagaatcacttgaacccgggaggcggaggttgcagtgagccgaaatcacactgcctcaccccagcctgggcaaaagcgtgaaactgtctcaaaaaaaaaaaaaaaaaattgaaagtcttctcataccatggtttgaattaatttgatatgccagatgattgtctattttagtgattttggggaaaatctatgcttctatttaatgaataatccttttttctctgttttcattctagtattttcagcttttctcttcatttcccttctcttgcttcttgttctgatcatttattatcatttataataataatttgtgtaaattattttatttagttttcttttttattaatgaaataatttagatataaattttcttcttcgtatagctttaccattctggagatttttatatgtattgtgatcacttactatatggtctataattgtagataatattttcattcactcaatagttatttgggagaatgttactgaataccttgtttaaatacttgttattggtttttcatttttttgcataatcatagaatgtcagatatataatatcttcatactatttattgtatccatttattgtgtctcaatatgtgtttgatttctgcaaacataatatggtaattgaatagattgcttgcacaatttataagaaatagagctactgatccatgacccctttccactaaaaattacattaaaatcatgaatgtcctcatttattttttatctactcactggcttagactgatagtgttaacatttgtctcaattctgtttctgacactttctctttgtgtgtgtctgtgtgtatttgatattgcctgccattatttgattgattcattcattcattcaacagaggcttattgaaagtcttttgaggttgggcccagtgactcatggctataatcccagcactttgggaggcccaggcagtaggatcacttgaggccaggagctcaagactagcctgggtaacatagcaaaaccccatctctattgttttttaacaaaataatttttaaaaagtctcttgcatagagcgcagatgttgtggtgatcaataaacaaggctctcgcactcatggaatttacattttagtgtaaggggtaggagaaagataggcattaaataaattgataatgaataaggaaatttcagataatattaagttgttttgttcgttttgttttgtgttttgagacagagtctcgctctcttgcccaggctagagtgcagttatgcgatccaggctcattgcaatctctgcctcctgggttcaagtgattctcctgcttcagcctcccaagtagctgggactacaggtgcccgccaccatacccagctaattttttgtatgtttagtagagacagggtttctccatgtttgccaggctagccttgaactcctaacctcaggtaatctgcccacttcggcctaccaaagtgctgggattgcaagcgcaagccacttcacctggacacaagttctttaagaagttgcaagcatcacttctacttatgttccccggccagatgttagtcacgtggctggtggaagtcagtcacgtgccatacgtggcagcaagggaagctgggaaatgtcgtctttattccgaacagtcctggtccaagaattttaaaaattggggatttggttgccattaagaaagggtgaattgacacgtgaggaagaactgtctctcatctcatcagtgtgtggagtttggatatgatttcatgtacaagcagttctcattggagtgttttaagaacttgagtggattgatttaatctgtatgcaaagtacatcattggttgctgtgtgaaggagtgtaggggctagaatggaaatggggacccagttatgaagttattttaggagtctgggaggcatgcggatgactcggactagggttggaggagctgagatggtgtgtaaggaacagacatgagctttatatttgaattacagctgttcattaaattaatatatggcacttccattatgcatccatgattaccatttatacctataaatagccttcgtggtccatccattatttttttcttgaatcctccttttctaatattaatactaacctcatctcattttctctttatttgttttcactgggtataacctcattcatcctttttctttaaaaaaaatctacttttttagatgtccctctctataaaaatcatcgtgtcagaattatttttataagccagtctgagagaatttgtcttttaatagagtggtttaatccattggcaatcctgttataactgttgcttgttcacagttcagtggccccatattattctttttgcttttaagctattttattttccatcttttgctctattgattgttttgtatattttatctcctaaattaaatggaacaatagctcttcttgttagaagccttttactgattttctttaccttcatgaaatatgtatttaaaattatatttgtctgaatattaaattcaaaggaaaaactaacctcttatttttcctggaagaaaatttggcttatatttactttccccatttacttcccaatgtctgttaaatctggcactatgcaagctggatttttttaagttattgaaatggctgtagactcacatgcagttgtaggaaatcattcagaaagatcccatgtacactccacccaattttctcctaatggtaacattttccaaaaccataatacaatatcataactgagattttgatattgatacaaactgctaatagtcttcggagttccccagttttgcttgtactcacatgtgaaagtgtgttgacttccatacagttttatcacatgtgtgtaggtttctgtgtctaccaccacaatcaagctattgaacaattccatcacccctgttgccctttaatgacaacatctcctcattcccacccccacccctaactctgtcaactaggtcttggttttctaaaaagtctaaaattttgccattgcaaaaattgtatataaatggagtcacatactatgtaattttggagtgggcgtttttcttccatcataatatgcttgagattcattcaaattgttgtatcaataatttgctctgggccaggcatgggtggctcatgtccataagcctagcacttgggaggctgaggtggggggattgcttgagcccaggagtttgagaccagcctgggaaacatggcagaaaccccatctctatttaaaaaatgcataagttagctgggcatggtggtgtgtgcctgtagtcccagctacctgggaagctgaggtgggagggtggcttcagcctgggagttccaggctgtagtgagccgtgatcacgccactgaactccagcctgggtgaaagagcgagaccctgtctcaaaacagaaaaaacagtttgcttctttttactgctgagtagtattttacaggatgaactgtttcatggtatgaaacttatttaacccactcacgtgttgatggacacctaggctgtctcaagtttttggtttttatgaataaagctgctgcgaccatttgtatgcaggcttttgtgtaaacatgtttccatttctccaggataaaagagctcaaatgcacttgcaggttggtatcataactgcatgttttgttttataagaaactgctattttttttccacagtgatggtagcattttacattctcaccagcaatgtatgagtgattcaggttttctgattctcaccagctttggtatgtcactattttatattttagccattctggtaggtgtggagtgatctctcaactgcagttttgcatttctctgatggctaatctttaacagtgatcatttaccatctgtatgtcctcttctgtgaaatgtctgttgatgtcttttgcccatattctaattggttagttgtttttgtgttttgttttgttttgctcttgagttttgagaagtctttatatattttgtatactactccttggccagatatgttgtttgcaaattggttagttgtttttgttttgttttgttttgttttgttttgttcttgagttttgagaattctttatatattttgtatactactccttggtcagatatgttgtttgcaaatgtcttctgcaagtgtgtagtttatcttttcattctcttcttacaacctttggaagaacaaaagcttttaattttgatgtggtctagcttttcgatttttcccagtatggactgtgattttagtgtcaagtctaagaactctgcctagccctagatactgaagattttctcctatttttttcttctaaaagttttatagttctatgttttacatttaagtccatgatccagaatttagttaatttttggataaggttcacacctttaggtcaagattcattttcttacctacaaatatccacttaccccagcatcatttgttgaaagggctgtcctttctccattgaattactttgatgactttgccaaaaatcaattgggcatatttatgtgggtgtatttctgggttctctgttctgtttcattgatccatgtgtctgtcctgctgccaattctacactattttgattactgtaactatatagtaagacttaatatcagttaagtgatttcttgtactttattctttcctgtcaagattgttttaactcttctaagatctgtgtatttccatgtaaattatagaataaacttgtctgtgcctactaaaattcaccaggatattgataagaattgccttaaacctataagtcaacttgggagaattggcatctttattatgttgagtcttctagtccagtggtctaggaatagcgtcatcacctttctggcaccagagactggtttcgtgaagacaatttttccatggaccaaggtgggggatggtttcgggatcattcaagcacatcacattgattatgcactttatttctattattattacattgtaatgtataatgaaataattatacaactcaccataatgtggaatcagtgggaaccctgagcttgttttcctgcaactagacagtcccatctaagggtgatgggagatagtgacagatcatcaggcattagattctcctaaggagcatacaacctagatccctcacatgtgtagttcacaataacattcacacttctatgagaatctaatgctactgctgatctgacaggaggtggagctcaggtggtaatgcgagcgatgggaagcagctgtaaacacagatgaagcttctctctctagcctgccgttctccctctgctgtgcagtccagttcctaaccaccgctcacctcttgctatctggtaccggtccatggcccgggagttggggacacctgttttcatccatgaaagcaatatgtctctcctttcattaagtcactgatttctttcacccacattttgtaattttaagaataaagatcctatacttgtcttgacaagggtatacctaagtatttcatcttctttggagtgaatgtaacatgtttattgttagtaaatagaaatgtgattttttgtgttaattaataggattaatttttcaaataggcaaataaaaattgtatagatttatagttacatgatgttttgatatctgtatacattgtggaatggctaaatcaagctaattaacatatcaattacttcacatacttactgagatcatttaaaatctaatctctcaggaatttcaagtgtacaatagactgttagctatagccaccatattatataatagatctcctgaactttctcctactgcataactgaaattgtgtatcctttcctcaatatctccccacctcacaactcctcagtccctgataactgtaattttattctctgtttttgtgatttcaacttttttagattctacatataagtgagatcatggagtgcttgcctggtttatttttcatttagcataatgtcctccaagttcatccatattgtcagagatgacaggatttccttctttttaaaagctgaatataatactgtcttgtaaccttactgatctcacttagttctaggagggattcgtttgtagatttcttgggattttctacatcaaagttgatgtcatcttcaaataaagaccatttaattccttcttttccaatctgtataccttttatttttcttattttattgagctggctagcacttctggtaccaacatttcctgacttatggttgttcaacttacaatttttcaactttataatgatgcaaaagtgatatgtattcactagaaactgtacttcaattacccatatatctgctttgctttttaactttcagtatagtatttaataaattatatgagatggtcaacattttattataaaataggctttgtgttaggtgatttttgtccaactgtatgctaacataaatgttctgagcatgtttaaggtaggttaggctaaactaggatgttcagtatattaggtgtattaaatgcattttccacttaaccatatttgcaatttacagtggtttttcaggatcaaatctcatcataactcaaggagcatctgtatgatgttgactagcagtggtgggagtaaatattcttggctccttcccaatcttatagagaaagcattcaattttttcagtccttcacattagctgtagaatttttgtagttgttctttaccaagttcagttaattcttctcttctttaatttctgaaagtttttatcatgaatgggtgttgtattttgtcagatgttttttctgtttcacttgatatggttatatgattttcttctttagtttgttgatatggtggattatgttgattgacttttaaaatgttaaatatgactaaattgattgatttttggctgttgaaccagacatgcttacctgacatgaatctgactttgtcatgttaccagtggccaatctgtatgggtctgcagcaaccacaattcttgccttctcagaagaaagaattcaaccaaggggcataaggcagagtgagagactgaggcaaattttaaggcaggagtgaaagtttattaaacagctttagaacaggaacaaaaggaagtaaagtccacttggaagaaggccaagtgggcagtgtgagctatcaagtgcgtggtttgacctttgacttagggttttatatgttggcatacttccagggtcttgtgtcccttctccccttattctccccttggggtgggctgtccacatgcacagtggcctgccagcacctaggagaggccacatgtgtatacagtgtacagtacacatgggtgtactggagttgcactcatgctctcttgagttggatgctcctagaaggtcatgcacctgttaaactctgccactttgccacttagtgcacatacacgagcccattcacccaactcctgagatcttattgagaagctgatcaccagtttcaggtttttctacctgtttagagactgcctttccctgatgctggctacaaccaattactgttacttagtgcatatacatgagtccattcacccaactcctgagatcttattgagaagctgatcaccagtttcaggtttttctacctgtttagagactgcctttccctgatgctggctacaaccaattactgttatttagtgcatatacatgagtccattcacccaactcctgagatcttattgagaagttgatcacctgcttcaggtttttctacctattgggagactgcctttccctggtgctagctatgaccaattactattttagagagacaacttaacaactacctgcccatcacctgatggtcttctgacattcctggtcgagagggaaccctctccggccctgctgatgtctgcctgactacctactgtaacagtcatggtgtatgattctttttatacattactggattcagtttgctagtattttgttaagattcttacatctaagttcatgagagatagggtctgcaatttttgtttgtttgtttgttttgtgctgtctggttttgttatgaggccttgtaaaatgaattagtaagtgtttctatttcttttattttgtggggagttgtgtaaaactgtttatgggagagatggtataaaatggtttttaattcatatttaaatggtagaattttccaatgtaactatttaggcttggagattttttctttttttcaaaatcttttaaattatgaaatcaatttctttaatggtgtagcatcattcagattatctatttcatctgttttaggggtttgtggttttccaggaattggtccaattcttctaagttgttgaatttatgagtataaaattattcatagtattcccctattctcttcttaatggttgcaggatatataataatattccctgtttcatttctgatattggtgatttgtgttttctgtggctgttttctgtcactgttgctagaggtgtgtcaattttattctttttttttgaaaaatatgcttttgtttcaatgatttttctcttatttttctatatccaatttcattgttttctgctcttagcttactatttgcttctttccacctgctttgtagctttttgttttgtattgttctttttttagtttcttgagataggaacttcgattattgattgacattccacgctcactttctttcagttctctgtatttttatttactttgagacttctttgaaccttgagttcagcagcgtgttattaattttccaggtatttagaggttttcctggtgtctttctgttgctagtttctagtttgatttcattatggccaggtaacatattctgtgtgatttcagttatttatatctttgtggtttgttttatagcctttatattatctgtcttggtgaatgttccgtagtcatttaaaaaaaatgcatatggctgggcacagtgtctcatgcctgtaatctcagcactttgggaggctgaggctggtggatcacttgaggtcagaagtttgcgaccagcctggccgacggcaaaacctgtctctactaaaaatagaaaaattagcagggtgtggtggtgtatgcctgtaatcccagctacttgggaggctgaggcaggagagtaacttgggaggcagaatgcagaggttgcaagtgagccaagattatgccactgcactccagcctgggtgacagagtgagattccaactcaaaaaaaaaaaatgcatatgctgctgttggatggagtgttctgtgtatatgagctagatcctgctggttgattctgctatgtagttctctgtatacatactgattgttctccctagtagttctgtcctttgctgagaggtggctgttcaggtttccaactataattgtgaatttgtctgttttccctgttaactctgtttttgcttcatgtattgtgaagctttttgatgtggccatatttaagattgcatatcatcctggtggattgatcctttgactattatataatgtccctctttgcttctattaaatagtgattttctttgctctgaagttgactttatttgtattgatgtagccactgctgcttcttaaaattaatattttcaggttatataattttccattctgcctatgttgttgaatttgaagtcagtttcttgtaaacagcataaaattggattgtgtctctgtccactttgccaatctgtttttttattggtgtacttagaccatttacatttaagttaattatctatgtaagtctaccattttattaatttttttctgtttggttccttggattcttgttcctctgtttttcttttcatgtagggtacttgaacagcttttaggattccatcttgattttttcattgcattttaaagtatatctctttgggtgcggtggctcacacctgcaatcccagcactttgggagaccaaggcaggcgattgcttgagtccaggagttcaagaccagtctgggcaacatggtgaaacctcatctctactaaaaatacaaaaattagctgggcatgttggtgtacgctacttgggaggctgaggcatgataattgcttgaactggggaggtagaggttgcagtgagccaagatcatgccactgcactccagcctggggaacagagtgagactgtctcaaaaaaaaaaaaaaagtatatctgttcgtatagtttttgtagtggttgctctgtgacatcagactttactggtatcgacattttgcctcttcaagtggaacatgaaaaccgcatttccttttagaaccattaccttccctgctcttaaatatcattgtcttgagtacaagaggttgttaataatttgtgtctcaatcattaaatataatttacacaatttagaaggaaaaggatagtctattgtatgtacccagattgctactgttcctcttatttcttcctcctccttgatgccccaagcttgattctcttcccatttcttttctgtttgaagaacttcttttagggcagtttttaagggtaaatctgatcatggtaaattttttggtttttctttatccaagaatgtttttatttcccctcatttctagagaataattttgccagatgtaaaattcatagatgggctgggcaccatggctgacgactataatcccagcactttgggaggctgaggcaggtggaggcacctagggaggtcaggagtttcagaccagcctggccaagatggtgaaactccatctttactaaaaatacaaaaataagccaagcacagtggcgtgcacctgtaattccagctacttgggaggctgaggcacaagagtcgcttgaaccctggaggcagagtttgcagtgagctgagatcacaccattgcactccagccagggggacaagagcgaaactccatctcaaaactaaataaataataaaattaaattcataaataaaaattatttttatttttcacaacttgaagaatgttgtgccacttctggcctccataatttcagatagggacattattgtcatttgaattttttttgcctataagtaatgcatcatttctttctggatgctttctagaatttttctgagtttttagttatcatcagaagttcaattgtaacatgtttttgcataggcttatttggattttttctgtatgaggtttgatcagcttgttgcatctttggtttgtgtttttcaccaaatttggagatttttggctattccttctttgaatactctttagcaccattttgtgtctcctctccttctgggactctgatgagcgttgaattttttaattgcccctgaggatctgtttatatcatttcatctattttctttctggtgttcataatgagtgaattttattgatctgtcctcacaatcactgattttgacatctgtcatctgtcctctactctcctatccagtacattttgatttttttcagttttgtaatttccatttggttccatttgattctttctttctttctttttttttttagagacaggatcttgctctgtagcccaggctggagagcagtggtgcagtcatagttcactgcaacccccaaatcctgggctcaagccatcctcctgcctcagtcactcgcatgagtagctgggactatcagtgcatgccaccacaaccagctaatttaaatttgtttttgtagaaataaagtctcactgtgttttccaggctggtcttgaactcctggcctcaagcaatcctcccaccttggcctccccaaagtactgggattatagatgtgcgccaccaagcccagctggttcttttttataactcctatttacttgcaccaccaagcccagctggttcttttttataactcttatttacttgttgagattttcttatgtttcatttgtttcagtagactttttaattgattgttgaaacatcatggtgacttctttttttaatttaattttattttattttaaggatacatgtgcaggacagtgcaggtttgttacataggtaaacatgtgccatggtggctatatcaacccatcatccagggtaataagccctgcatgcattagctatttatcctgatgctctccctcccccttgctctcctgacagactggataaagaaagtggtacatatacaccacggaatactatgcagacataaaacagaatgagatcatgtcctttgcagggacatagctggagctggaagccattatcctcagctaactaactcaggtacagaaaaccaaacaccacatgttctcacttataggtgggagctgaacaatgagaacacatggacacagggaggggaacaacactcactggggcatgatggtttctttaaaatcctttgtggatgatttcaatgtctgactcatctcagtattgaagtcagttaagtgtcttttctcattcaagttgtgagtttcttggttcttgatgtgatgagtgattttctattattatcgcagatatttcatctggtagcttcatggactctggattctatttaaatcttttcttttagtaggcagttatcttgtttaggtttagtcatgtttaggtttagtcacctcgtttaggtttagattctggtatacttttgcggactatggttgcaatgagaacttgtttgcagtgcctttatggtgctctattagccagcctggtttatacagggctgctggggtcccagtggttcctcctggtgcttcttgacggggcagaaaagattttcttaggcaaagatggcaggtgtatctctttgcgggaggagattcttaagcaggaacaaggaggcttcctaagccaagtgctttttatgacgagattctcctctgctgtggggaacagagcattccccaggccacgcacttgtggttgaatccactatactgttgcctccaatctctgggcaacagtatagtggattcaaccacaaggatcaggctgtttgttttggtggagatctaccttgctggggctgtcgtgttatattttggtgagagagggagatttcaggcctgccagggaaggaaagcacctcccttagctttttactgttagtggtattccaatagatcctccttgcctgtcatgtggggtttgtctggggctgctctcaaactcctgacctcaggtgattcacccacctcggcctctcaaagtgctgggattacaggtgtgagccacggcagccggccttgtgtttagttttgtatcatatttacaacagttaattttgatacaggagctagaaagaaattacttaggcagatagtgaggctaaaggaattctcagcaaggtttcccttttaacaaaaagcagccccaaaataatttcttttctaacaaagagcagcctaaaaactccagctgcaaacataaatcagcaggctaaagcttgcacgggtgaatgacagcagctgtgctaataaaggaggaacctggaagccaggtgcgttcagcacggaggctctgtcttcccttctctcttcatcacgtgtacagtaaggaccaggcaacatggccctgggcaggtagagaacccatgtgcgtaataaaaaattaggaaggggcgccaggcgcagtggctcagacctgtaatcccagcactttgggaggccgaggcaggcggatcatgaggtcaggagatcaagaccatcctgactaccacggtgaaaccccgtctctactgaaaatataaaaaattagccaggtgtggtggcgggcgcctgtagtcccagctactcaggaggctgaggcaggagaatggcgtgaacctgggaggcggagcctgcagtgagctgagatcgcgccactgcactccagcctgggggacagagccagactccgtctcgaaaaaaaaaaaaaaaaaataggaaggggcagccaggttcttcgtgagctatgcagatggcacacctggtccaaccaatctttcgtcctctatgtaaatcagacaccacctccttaagctactctatgaaaccttctgcatttcagcacagaactggcaactcatctttctccaggacccctctctgtacagagggctctcctctttctttcgcctattaaacttttgctcttaacctcactctggtgtgttggtatccttaatttccttagcatgaggcaacgaatctcatgtattactccagatgaataacaccacttcaattttactatcactgttttttttttttttttttttttgagatgaagtcttgctctgtcgcccagggtggagtgcagtggcacgatctcggctcacggcaacctctgcctcccaggttcaaatgattctcctgcctcagcctcccaagtagctgggattacaggtacccaccaccatgcccagctaatttttgtatttttagtagagacggagttttgccatgttggccaggctggccttgaactcctgacctcaggtgatccgcctgcctcagtctcccaaagtgctgggattataggcatgggccaccgtgcctggcccaattttactatctgtaaacagtttttatttacattgtcattcctttgtactttaaatttcttacatctgaattgttaattataattaatctcataaaatttttaaaaatttaaacatttcttaaaaatttttatagtaggggttgggtattactcaagagacatatttttctaggcctttgcagatctgaaaatattattccattaactttatgaataaaattaaaataggactgaatatagagtttggggtcacaacatttaaatttcagtcgtataattcaacattttttgtagtaaaaatgcttcatatcagttcatctcttgcaggttcataatgtacattagtttaattaaggccttcatttgagaaggttgtttaattttgtttagcgtatcgtgtctcaagtgataaaatgatgatgatggaatttttgtgtggtgtgcttttcctgttaatatttatatcctcaggctgggcacagtggctcacgcctgtaatcccagcactttgggaggcgaaggcaggtggattacttgagcccaggagttcgagaccagcctgcccaacatggtgaaacaccatctctactaaaaatacaaaaattagctgggtgtgttgacacacacctgtaatcccagctactcaggaggtggaggcaggagaatcgcttgaacccgggaggcagaggttgcagtgagccgagattgtaccactgcactccagcctgggtgacagagtgagactccatgacagacaaaaaaaaaaaaaaagcctcattgttgcccaggctggggtgcagcggtgcaatcatagctcactgcagcctcaaactccttggcttgagtgatcctcccacctcagcctcccaagtagctaggactacaggcacacaccatccactaagagatataataagtgagcacttacttatatctaaaagagaacttgacaatgacttaaatactaaagacacagacctaacaaaaatgggcagtcaaggtggcaacagaggctggtgatatgtcttcctgggcctctgcacctccgtcttccactttacatcctcagcctgtaggaagtacatcctcatccatgttgccttctggctacaaaagggctgctacagcctcagacaccagaactatatttggaatggggtgggggtggtagcaaaaaaaagcctttcttctccaatggttctctttcttctccaatggttctctttcttatgagcgaagggaactctttctcagaaatctcctagcagcttttccctgtaagtttcatcagcaagatcagaatggtatgcctactcttagcagcaagagaagctgagaaaataggaaaagaggccagtgatcgtgattggcttagatctgctatgatccacccttggtgctggagtctgtcaaccttaagtaacgagatttaataacgatatttcggctggtctcgaaaatatgattaagtatagagtttattgcagcccaaaggtaagaatagccattcaggaaacacaaactccagagaaatggggtcagtgctctcaagttaaaagttaaggtctttgctgggtgcgatggcttacacatataatcccattggtttggaaggtcaaggctggaggattgcttgaagccaggagtttgagacaaacctgggcaacataggaagaccccatctctgcaagaaaaatttaaaacttagcgggcatggtgatgtgcacctgtagtcccagctactcaggaggctgaggtgggaggatggctcaagccaaggagtttgaggctgcagtgagccatgattgcaccactgcatcccagcctgggcaacaatgaggctctttctctaagaaaaataatagtaaaaaaaaatgtgaaagtcttgcttatataggcagtaaacaaaggaatttagtagaattataacattttcttatacaaggctagtttatgagctgcagcaatttagttagttacagtttattttcttttctatgcagcttgttttcatttcctttccaatttaaacaagtgtatttaacattccatcttagacaatgtgatagtcataatgtctttgtgttagaaaggtaagtgggaagttaatctataatgaagataaacagtgaacagagaaggggtcttccctgatgtgctttcatcatttacaatttctaaaacaatgtattaacaggtaaggaagaagaataatctataatcatacaaacaaaggttatagctgcctaggttacagctgcctgtttatgtgactcagttcccataatcacatgcccttaagggtcaaagtattttaaagttccaacagcttagattttgaattacttatttttacaactcattattatcaaatcaaatcagttttttgttttgttttgttttttaagaaaggaagaggggaagtgagtggcttctggccataccacaaatggcaccagccacaaccttcctctaagtaaaattgtaggcagaatgcctcactggaactacttttaagtatctgtcccttgttttcttgttctttgtagaaaataagtttgaacttggcttgattatattccttgtagagaatctgttttgtacaacctgcctggtgcttatgatttttttttcttatttgtttaaaatcatgttatagattgattggtcagaatggttcatctttattactttgctttgcacttctaaaatgtaggcacaggccttccatccagtgcagttttctgctattctctttttttttttttgagacagaatctcactctgttgcccagactgcagtgcagtagcatgatcttagctcatcgaaagctctgcctcctgggttcaagtgattctcctgtcacagcctcccgagtagctgggattacaggcacccaccaccacatctggctaatttttgtatttttagtagagacggggtttcaccacgttggccaagctggtctcaaactcctgactgcagatgatctgcccgccttggcctcccaaattgctgggattacaggtgtgagccaacttgcctggcctattattttcttttttaattcttgcttatgctttcgttttgttcttactcagccttatggttttctcctgtgcaacacatcgaattcttacttctgttctcttccttcatatttgtcgaccccccccctcactgtttcataccttttccatctgaattcagagacattctgatgttggtcctctgcgttagtactcctgatttagagagattctaatgttggtcctctgcgttagtactccttgatttctggagtgtatgttgtgctgtatgaaactgttaaccagaaacgggccccaatccagaccccaaagagatggttcttggacctcgcacaagaaagaatttggtgcgagtccttagagtaaagtaagagcaagtttattaacaaagtaaaataacgttattaagaaagtaagggaataggctgggcgtggtggctcacacctgtaatcccatcactttgggaggccaagactggtggatcacttgaggtcaggagtttgagaccagcctggccaacatggtgaaaccccatctctgctaaaaatacaaaacttagccgggcgtggtgatgcatacctgtaatcacagttactgaggaggctgaggcaggagaattgcttgaacctgggaggcagaggttatagtgagccgagattacgccactggactccagcctaggtgacagaatggagaaaaaaaaaaaagtaaatgaattaaagaatggctacaccacaggcagagcagtggcatgggctgctcgattgagtattcttatagttatttcttgatgatatgctaaacgacggatggattattcatgagttttccaggaaaggtgtgggcaattcttggaactgagggttcctcccctttttaggccatatgacattgccatggcatttgtaaactgtcatggtgctggtgggagtgtcgtttagcatgcttatctattataattagcatatgatgagcagtgaggacgaccaggggtcactttcatcgccattttggttttagtgggtttcggccagcttcttcatggcatcctgttttatcagcaacatctttgtgacctgtattttgtgccaaactccaatctcatcctgtgacttagaatgacttaacctcctgggaatgcagcccagtaggtctcagcctcattttatccagcccctattcaagatggagtcaccctggtttcaaagcctacacaacctacaacgtaattttgattttgctcttggttttttattttcctagtatcttcttctgtctttcttgaatccctttcggcttcattcccttttcaatttcttctcctcctgcttctgttccatagtgtgcctggattttttttaagacactaagctgtgttaaagcaccatctttgtttgctaacagtgatttttggagttgtttttctcctctaatcaggataatgtttattttccttcatttccttttcaaaactattgtgctaactcccctccaaccctcgccccggatccgtattttcccagtatcctgcgatttgtcgcaaagtgcaaaggttatctatcttggttttccaatttctttggggctgtttgtcttcttgtggctcagagagtgtacttggtggtttctttctacatcgtttctcagacacacggctgaattagacacatagctgaattagtggaaattcctcccagatattggccttgtgatcatctttttttttttttttttaatagatggaatctcactccgttgcccaggctggagtacagtgatgcgacctctgctcactgcaaacctccgcctcctggcttcaggcagttctcttgcctcagcctcctgagtagctgggactacaggcacatgccatcacgcccagctaatttttgtgtttttagtagagacggggtttcaccatgttggccaggctcctctcgaactcgtgacctcaggtgatccacccacctcagcctcccaaagtgttgggaatagaggtatgagccaccgtgcccagccagtcatctcttatctatagttcacagttggcactatcttttttatttctttgtgtattcttctgggaaattagcaaggaaatctggtttgactctgggccagcatgcaattggctgatacttgcaaaattcccagtgaggagtaatagaaaaaagcacagggctttgaggcaaataaacttactcccagctgtgcctcctgtttgctgtgggactgtgagcctgttattgtgcccctctgagcctgcttccttagctctcataggaatgtctgcatgacaaggtcattgtgaggatgaaatgagagaccacatctgagatgctggacacactgtcactcactgtgtgtccagtcccctccctcctattcccatgtagtgctctacatggaaacagcaagcatcagatttcttgtgaaccagctctgatcgatggcccgggtcagcgtctgtgcctggatctcattctcatagctagggccctgcttttagcgtctcatacgtggagacttctcctaatttcccagaagaatacacacagaaataaattaaaaatatagtcagtgccaactgtgacctggagataaaagatgaccacaggcctatatctgggaggaatttccactaattcagccatgtgtcggagaaaggatgtagaatgaaaccaacaagtatgctctctgagtctattccacatgactgtgggcttggggcaccggctatgccttcctgagagccgcctctgccgcagtttctgtgcctggcaggatgcgcgcacacacctttggagatacgatatggtgttgtggttaggctcatagatgctggagccaactggctgcttctgagtgccagatgccccttacaagctgtggaagcacagtcaacttcttctccttatttttgcttcatttccttcatctttaaagtggggatatgatttacacacctcctagggttgatggaactgtgcaaagcattaaacacttcctgacacatgacaagtactgtatcagtgtctgctgtgatgacgacaatgatggtggtgatgatgatgatgatgaagatggccatccttgtcgttgtcatcagacattgtctcttgctgcagactgtttgctgacacctgttgtcacacctgggcactctgtgccctgctgcctgactgacacggcctcccttcccccactgctctccagtctgtgtccctggacccgctggattcgaggagtgaggtctcattcccttccccatctgtcctgcactgtgcagtcaccttctccactcccagctatatatgcccaacactaaaaaagataaaggatggagactctagagcctgtccttagagacaataaaaaagagacgagcctgctatccggaaagatttagacatttatctgcctgcaggcaagagactgaactgcatgatccttcaaggtcacgcctctgctcaaaatctttcaaagactccacttctccctgaggacagtgcaaattccgaaacccttcatgatctgcctcctaagcccagtcccctctcatgggggttgcgtaacactttcacaagcctaccctgaaaacctcccaaattactcatggtcccaacacatgtcctcgcacctccacacttgcccagtggctcttccctgtgcccatgggcccctccctttctgctctcctccctgaagctaatgcctgcatcatgcattcataggctgcttagtagtcagggcttgctggggaagcagactgcctagcccacccctgggggccctgctcctgtgtcctcacagcccccgcatggacttgtgaaatagcacacgggcccctgtcctgaagccagtggttcctcgtgttcacagacactgaataagcacaactcgtgacataatcaaagcacaacttttatatttgtttccttctgttgcccctttaaaatgtatcccatcagagaaatgtcactttgtccctaggtgaaaattctggcaggcctgtgacttcagtgtggaggagatttttttttttttttgacacgaagcttcgctctgtcaccgaggctggagtgcagtagcgggatctcggctcactgcaacctctgcctcccaggttcaagtgattctcctgcctccacctcccgagtagctgggattacaggcgtatactaccgcccggctaatttttgtaattttaatagagacggtgttttgttatattggccaggctggtctcaaacccctggtctcaagtgatctgcctgcctcagtctcccaaagtgctgggattacaggcatgagccatcgtgcctggccccacaagacttttaagaactaaatattttactcctacaacaaagtacagagcaaatataggaaacaccatgttatataacaaatcacctgtactgaacaaatgttaaactatgcagcatttgcttcagaatttctaaagaggtgaaatattgtagatctgtgtcctcttagttttcttcccggttttaagttcttctctttttcccactgggccacattggcttttatcttttctaaccacatttttctgtttttctatgtaggtgtgtagtgtaaacagtaatgtgctttacataaaaggcatcaatgaaaggtgatgtctgcagctgaagatcaagacctttattctgctcagccagtttctgttcacccacactgtgcgtgttgagaatatcttgtataattttatctaaatggtgtaagactgcaatgagctgggtttatatttttaagcatcaagatgctttttaagatttatctggccaggcacagtggctcacacctgtaatcctcaggtttgaggcctgaggcaggccttgggaggccaagtcaggtggatcacctgagatcaggagttcgagaccagcatgaccaacatggtgaaaccccatctctactaaaaatacaaaaattagttgggtgtggtggcacatgcctgtggtcccagctgctcgggaggctgacgcaggagaattgcttgaaccagggaggaggaggttgcagtgagctgagatagtgccactgcactccagcctaggtgcagagcaagactctgtctcaaaaaaaaaagagaaagatttatccatgttgatgcgtgtcaatatagattattttaaatgctgcagaatatttcattataccatcatcaatacatccagtctcataccatggatcatttagattgcttccaaatttttattattacaagtcatgttgctattgaaatcataactactggccaggtacagtggctcacacctgtaatcccagcactttgggaggccaaggtgggtggatcatctgagatcaggagttcaagaccagcctggccaacacagagaaatcctgtctctatcaaaaatacaaaaattagcagggcatagtagtgtgcacctgtaatcccagctactcaggaggctgaggcaggagaatcgcttgaacctgggaggcaggggttacagtgagctgatactgagccactgcactccagcctgggcaacagagcaatactccatctcaaaaaaaaaaaaaaaaaaaaaaagaaaactacctgtacagcatgagtttctttaggactgtgttattgggaatacatatctttagttccattaagaattggtaagttgttctctctttgtttttaaagtagagatggggtcttgctatgttgtccaggctggtcttcaactgctgggctcattcaatccttccacctcggcttcccaaagtactgggattacaggcatgaactactgcacccagcctgctgcgttgctttctaaagagctttgtttcaatgcacaatctcatcaataccttatgaaagctcccacttacctgcatccttggtaacttaatctttgccaatacgcagagtgtgaaatgatatttcatagtcgttttgatttgctctgcttttcacttcagagaggctgaacatttccccgtctttattggccagttgggttctctcttttgtagcttgcctgttcatcgtctttgccaggtttttcaatttggtggtgtgtctttttcttctttgttttgattcattgttgtactcttacatggagtaactcagtgctcctgggcagtagcaagcagagaaataataactcaagctacagtctgcctggacggctccaaactcaagccaacttgctacgtccccaggagagagaaagaacttccatctttgccaagtagaagaatctgggcagtaatgaatgaggataacagccaaccatgtgtggatacttaattgcgtgaatctgcaactccatggttcatttcctacataagcttagccagagtcattcaggtgtgtttgccatacagggttactctaagtgtatgctaaagttattgctgtcaggtgcatttactctgcagctggtctgggatggccttgggtggcaagacccaactcctgccatgggtctcccatatctctccagaagggtaccagcccctgccatgggtctcctgtacccctccagtgatgttcacatggtggggcaggattgaagagggagagaataagcacctccacatgttcatgagtcactggaggctggaaccagtcagcatggtccaaatgttctctccagtgcgtgggggcaagttaactcttctatacatgactcaaattcttcacctggataacatcattcttgctattttggttattgtgactttgaaggatgatacactacatctctcttcaaattaccgtttatttcatgagatgagtagattctgattctaaagcaaccaggagtggcttacacaccttgcgactttgatcaagcatttaattctacttggctggcttcctactactttcttggccttctcatttaaatggtcaaaggctcccaatcatttcacacttctgcctgttcccccctcactctctctcttccaccctccactatgcaaagagaaagagtgtttttttggctcatctgtgctgtttcacctgaattaacctcgctagctagaaagccatcatcttttctttcctcctttgtaagagagtattcttttgattaattatttactcttaagagtttatatatattttttagattagctagaggtccatctatattattagtctttacaaactattatcttttggcgcggttatcatctcctctgtttttttcgatcataatttattaatgtctctttaatatagtttgattatatttattttcagcatttctgtgtgtttttacttgggtttgtctttgtaagtagcatatagctggatttaaaagcatccaatcagctgggtgtggtggctcatgcctgtaatcccagcactttgggaggccgaggtgggtggatcacctgaggtcaggagtgcgagaccagcctggccaacatggcgaaaccccgtttctactaaaaatacaaaaattagccaggcatggtagcgggcacctgtaatcccagctactcaggaggctgaggcaggagaattgcttggaaccaggaggcagaggctgcagtgagccaagatcacagcattgcactcccacctcggcaacactcgcaaaattccgtctcaaaaaaagaaaaaaaaagcatccaatcagatagtctttgcctttaaagagatcagtttaatccacttcctctgtgtgtatgtgtgtgcacatatgtgggtgtgtgtatgtgtgaatagagacactgttggactcatttgtactatccttattttgtgttttctatatcattggttaggttgcattctttacctgttgagtagattaaccctcttctcattttgtttccttctgaattggcatcattgtccgaggtaaatacctgaggttcatgcctcatgccgaggaaatcaaggacacagacacacacaagaagtgagtttaagagtgaaggtttaataggcaaaagaaagagaaaggagaatagcttgctcttctcgagagagaagggtgcctgagtgggactcccagctggcagcagactgcactggattttatagacaggcttgaggaggcagtgcatgatttacatagggcccacagattggttggaccaggtgtgatgtttatatagtgtgaggggaagctggctgccccaccctaatcttattatgcaaatgggctttcacttggcctgcaccaggttgtctgctccttactgcacacgtggttggcaaagagaagggaagatggagccgccatgttggacatgcctagtcccaggtagcccctttcctactggtacaactgccggcattcacccatgcaagcttctggcctgcctttctatgtctgcagctcagttttacaggctgctgtttgttagaaaaggaaatgatttgggggctgctttccactgaaaggaagactttactgaggacttccttaccctcactatctgcccaaatcatttcttcttaactcctatttcacttccttggtttggaagctataaattgtatttctgttaatttagaggttacccttgcatttattttttattctgttttgttttgcgacagagtttcactcctatggcccaggctggagtgcaatggcgtgatcttgactcactgcaacctctgcctccccggttcaagtgattctcctgcctcagcctccagagtagctgggattacaggcacctactgccatgcccagctaattttatatttttagtagagacagggttttgccatgttggccagggtggtcttgaactcctgacctcaggtgatccacctgcctccgcctcccaaattgctgggattacaggcgtaagccactgtgcccggccgacccttgcattttaatatcttttaaaatgttttaatgaagttcaaaattaattattcagcatctctgtggccaccgccaccttcattttttcttgattttttgggtgaccctgataatatcacagaggcagggagacagaggggcttcacattggctgaccagaggcatctggtactcacctccttcacaaagaagaaccaaaacagccagtcgataatcacatactgaatagatcacctaagagagaaagctagaagtcaactaaaaagtgagaaaacaccaaaggcaaggcgagggaagccaggcagcgtgcctggctgggatgagctgggagcctgcagtgtttcccattgcaggaaaagagtgagtgtttcagaaaaactcttcagctgtgtttttcctcgactctcgtaccaccaccaccacaactgtcaacacagaggaagacttctgtgaccagatgcgcaggggttttcctcccacaccaagcagcagacacaagccgggagtccttcaattccattctgacactatctacctagagagaggtaggtagttccaccctccaggaacttccacgtgttcagctatccagaagctccccaaactgaaccctgtcctcttgtttttttttttggttttgttttttcatttcagacagggtctcgctctgtcgctcaagctgtagtgcagtggtgtgatgtctgctcactgtaacctcctccgcctcccaggttcaagcgattattgtgcctcatcctcctgagtagttgggactacaggtgtgcctggctaatttttgtatttttagtagaggcagagtttcaccatgctggtctcaaactcttgacctcaggtgatccttccgcctcagcctcccaaagtgctgggattgcaggcatgaaccaccacccccagcccctcttgggtttttatggatgcctcacgatgtcagcattttgtcccccagggtataggggaggaccctctctggaaagggtcttaagacccacaatcagaaaggcaggggaagattagagtcctgcctttgggcagatgaaaggggggcaggggaaaatcagagagattctgtctcctgagacttgttcctaagatctaacacactaaatattataacaaaagactataacgagggctaagggagttatggaccaggaaccatggataaaaactaatatatatcatagcactgcggtgaatgattcccggtgtccacattcccactgtagactcctgtagtcttagccagggagccacgggcagtgtggcggtgtcctggtgtgtggtttttctgcttcctgtggccttcttaagatcagctccatgtcagccccagggttggaaagaaccctgtggcctcttttcctgagtcgaggagcctgctctcagcacctgctttcaaggaatgagctgagcccaggtgtctcattttgtagggggcaattttagacatctttccacaggaggggaggagcaccccgctacctctctctgtttctgtacccgaagtcagcaggccttcagtttcagggcaattttctgcattacatttgggttccgtttttggcctatagaaatgattactttgttctttaaatggacagtgtctttcccttatttatgttgcagagggcgtggaagtggtgctcagagcaggcccttctatcgcccactggactggtgtactgctgctagatcctgagttacttgaggataagaaccatttaaagtatttcatttctatatccctatgaggaacactatgccattgtaaagtggtgtcaagaattctgatgtgttggctgggcgtggtggctcacacctgtaatcccagcacttgtgggagtccgagagacaggagaatcacctgagatcaggagtttgagaccagcctggccaacatggtaaaaccctgtctctactaaaaatacaaaaattaactggacgtggtggtgcacacctgtaatcccagctacacaggaggctgaggcagaagaatcacttgaacctgggaggtgaaggttgcagtgagcagaaatagtaccactgtgctccagcctgggcaagagagtgagactctgtctcaaaaaaaaaaaaaaaaagaaaaagaagaggccaggcatggtggctcacgcccgtaatcctgcactttgggagtctgagacaagagaatcacctgaggtcaagagtttgagaccagcctggccaacatggtaaaaacctgtctcttctaaaaatacaaaaactaactggatgtggtggcacacacctgtaatcccagctatatgggaggctgaggcagaagaatcccttgaacctgagaggtaaatgttgcagtgagcagagattgtaccactgcactccagcttgggcaacagagtgagactctgtctcaaaaaaaaaaaaaaaaaaaaaaaaaagaatcctgatgtgtctgagattttatactacttgcatgctaaccagtgacctgccatggttttctggatgctagcagaagacatgagacacctaaattatacaaagaactttattcctcaagccatagcagtaggcagagtatcattatttttagttggtcccctgagccccagttcccatagagcaggggtccccaaccccccggccgtggagcagtaatggtccatgacctgttaggaagcaggctgcacagcaagaggtgagaggtgggtgagtcagtgaagattcatctgtatttacagcctctccctgtccctctcattcctgcctgagctctgcctcctgccagatcagcggcagcgttagagtctcatagaagcataaaccctattgtgaactgcgcatgtgagggatctaggttgcacgctccttatgagaatctaatgcctgatgatctgtcactgtctcccatcacccccagatgagactgtctagttacagggaaacaagcccagggctcccactgattttacattatgatgagatgtataattgtttcattatatattacaatctaataataatagaagtaaagtgcacaataaatataatgtgcttgaatcatccccaaaaccatcccctctccccagtcctaggaaaaattgtcttccatgaaaccagtccctggtgccaagttggggaccactaccatagagtgatgctcagaggacacagtgtcatctgcataaaattataggggaggaccccttagctaaggggcagtaggcttgcctgacctcagtcctggagggagacatcatctctaccatactgggcagtaattaaatttgcactttctctggagggagacactgtggcttcaaaggctgttctctctgcaaacatccttgaaaagacagtactgaacaaaagcatttggtgcctgtgcttataagacatacagaaatgtaagagatccacagagaattgtcttccaacaaatagttgctcaataagtcttttccgcagtttcattatgtgcataaatgtactacagtgataggatatagtgaaagcataatagtcaccagagatggaggatggatctctagtgttgcctatgactctgggataaactgcagtcaattcagggaagtttggtctctctctatatgcacaatgggaagtaataggaccaggcaaaagcctgtcaacaataggtctcgtgacaacacctggagccacagctggcgctgcccctgccctcagtgctaaggctgctactgttcttcggccagcaccgtaaagaattcatgcctgtaatcccagcactttgggaggctgaggtgggcggatcacgaggtcaggagatcaagaccatcctggctaacacggtgaaaccccgtctctactaaaaatacaaaaaaaattagctgggcgtggtgggggggtgcctgtagtcccagctacttgggaggctgaggcaggagaatggcgtgaacccaggaggcggagcttgcagtgagccgagatagcgccattgccctccagcctgggtgacagagcaagactccccctcaaaaaaaaaaaaaaaaaaaaaaaaaaagaattctctagagtccctgagtttttgcaatactgactcaagattcagcatcgtgattgcctgcatctggttggacgatccttaggcatagaagctgacttgtttgagggtttattctcagaagtggctcaaattcccaccaagactcttatggtggggaagctcccagacgtaagaaaggaatgcagatcttgagcctacactttgcttggacacatatctttggcagctgctaagatgtgtgttagtctgcttttgcttcaggagctggtgggcatgaagagggatgattttggttttctttgcattgctttttttttttttttttttaaagacagagtctcactctgtctcccaggctggagtgcagtggcacaatctcagctcactgcaacgtctgcttcccaggttcaagcgattctccttcctcaacctcccaactagctgggattacagtcgcccgccaccatgcacggttaatttttatatttttagtagagatggggtttcaccatgttggccaggctggtcttgaactcctgacctcaggtgatccactggcctcagtctctcaaagtgctgggattacaggtgtgagccaccacacctggctctttgcattgctttttgtaagcactgtggagacatgtgtctcaggtaaactcccagcaggtgtccatagcccatgagacagacctgtgtggctgagtgccaggcactagcccctctgattgtaaaatctgatgagaggaagcaggtgcaacactgtctggtctaaattctcatcaaactcacgttttcatttttatttatttatttaaaaattttgaaacagggtcttgctgtgttgcccagactggagtgcagtggtgccatcaaagctcactgcagccttgaactccttggcttaagtgatcctcccacctcagcctcccaagttcctgggactatacaggtgcatgccgctgtgccagctgatttttttctttttcttggtagagatagggtctcgctatgttgccgaggctggtttcagactcttcccttggcctcccaaagcactgagattagagacattgttatcaagcaaaagggtgcccaatgcactagaattgattttggtttttgaccaaaatcagttctatgacatcaggttttttagaaaagaaaagctttatatggaaagtcaactcataagcagacagaagtgtcaagatcaaattcgtctgtttgtggttggcttcaaggcagtatttttattagaaaaggttcgggtggattttgagattaggtgattggtggaaagaaagtgctctggaaagtccttgggcatgcgcagttatctcttcatgttagctcacgggttgcacgtgcaaattgcagggggagttagtctgaaacaggcaggggaaattcaggttgtgacatcagcaggctccttctgtgcaaactccagccagccatcttggttccaatcgatttcagtcagttcttttatctcataagcagagggagtttcagccagttgtttctttttctatctgccatcctgcagactcaagaatttccattcacttttggtttcttttaactctttgggggcacagtttcagcgtgagtcactgcacgcagcctttcaagcagcctatccattttcaataggataaggatcaaagggaggacctcgttcatttcccatctctgggaacatctcagccatccctgcgcccagcgctcctgtctctggacagaacctaggctagggttccgtgcaagagtctgtagaggccatctatgctccaggacacaggctgctcccatttctgcatttggggagggagaatctctgggagaaggagccaggctcagtgctgggaatgtgtggcccaagaccatccccatgacctagctccacaaaggaagggtccctggaaggtcacgtccagctatcatatttgcctttctctctggttctcagtccaccctgcttggggatgttacgtgattcatcacctttcagtcattgccatgaccagatggccagccttgggatctacccccatgtgttttacatcagtgtatcctctgaagttctttggttcttgaccgaaatcattgttcaaataaagtcaatggtggacccaagaccagtgaccagaaataaatgtttgtcttgagaatcctctcagtctggtgtgaatggttggaaattgtctcttgtggagaccggagtctggcataattagagtgtactcgagatctcaaattttaaaagccttaatatagctggtaatactattaggttggtgccaaagtaattgcagtttttgccatcaaaagtaatggcaaaagctgccattactttggcaccaacctaacctaatgtgttttgtactgaaactggtatcatgaaaagaggatggaagagcaagagagtgaaagttagtgcatggagggaggattaaggggcatgggtcttcatggttaaaaataattattggtgtgatctcattaaaaaactaaataaaaaagaggccgggtgtggtggctcacacctatcatcccagcgcttttggaagctgaggtaagaggatcacttgaggccagaaatcaagaccagcctgggtcacaaagcaagatcctatctctagaaaaataaaaataaaaaattagctggttgtggtggtgcatgtctgtagtcccagctactgtggaggctgaggcaggaggatttcctgagcccaggagttggaggctgcagtgagctatgattgcactgctgcactctagcccgggcaacagaacaagacccccttctttaaaaaatataaaaataaaaatgaaagagcacaggtatgttccatgaagcacatggaagatattggatatggattgtgccaggaaaattaacaagggaggtggtggatgggatagagactacaaatattgattctgccattggatttaaactttattgttttttatgactgaggacacagatgccacccaccagaggaatgaatgtcaaattggtggaacaagaggctagcacggggctcacatccctccctaaatgtgcctctgttgcaggacctgtctctgggcttgtttgctgggatgggtttgcccagagaagagtatctgtccctgcacagcacccttcttgctgatgagaagaaacacagccagtgactaattggatttggtgaaagccccagctggttgggtgggatttggtgactgatgtgccgccctgctgtggcttcctggcttaaggacaggaccttctttccccagacagaaggttaatgagaacagagagcaaaacatctcaggggccttcatctcatctcccagaactattgcccaaatggagcctgtgctggcttccaacctaattgctaatccgagcggaattgcaccagtccaacctcggagctacagagccgtaggccaggtggtgaccgtcttccttcccagagtgccagaaagtttgttccaactgacagcagggccaggggaaaagaacgtctgtggctgcactttccaagtcacagacatctctgcggatggtttgttccccagaacttgccaatacctgcccacttaatgcttgtcaattcatccagatcacagattgtcactatagtctactgctttctgcccagaatcttcaaggacagaatggtcagtaagcatcgtagcagaagaaaacacctcaaggggtggtggaacaggcacctagcctgtgtattcttttctaaaaaggactagatagcaatataagctgtgtggggtttttttttctttttctttttcctttttttttttttttttttttttttgagatggagtcttgctctgtcacccaagctggagtgcagtggcatgatgtcagctccctgcaacttccccctcccgagttcaagcaattctcctgcctcaatctcctgagtagctgggatcacaggcacgtaccaccatgcctggctaagttttgtagttttagtaaacacagggttttgccatgttggccaggctggtctcgaactcctgacctcaggtgatccacctgcctcggcctcccaaagtgctgggattacaggcgtgaaccaccatgcccagccaagctgtgtctttattgcaaggatgatccaagttaataaagatcatcattttgtttaccatatatttggttgaattacatcaattcagactatgcagggaaggccagcctggactacttagagatacctcattatttagacattttgaagaaatggggctttattacagcacatccccacatttttgtatatcgaaggtaattgaaactaactgctacttttaaaaagtatttttaaatggaatctctgagacacattgataattagagcatccttttataccctcaattaaaacgccaaagtctctggaagttttctttttacttaagtcacttaaacgtagctgcgtcattttatttaccctttgtttggcaagggagctcattttcagtgataatggagatgaagacttaggccctcccctcatcaaattatcatgcatcttaaatgtgccaaatctaaaattcttaatgagggtttacagttcataaacacgtctctggttttaaaagcctcatcttaagcaaggagaagacacatttctgctcttgccacgcggtgagataaccatatattggctcacagatacgtatcttctggcttacccattatttctatggtgcaaacatcagaagcaaggaatactcaaaccagaattcaggctgggcaaggtggctcacgcctctaatcccagtactttgggaggccgagacggatggaacacctgaggtcaggagtttgagaccagcctggccaacatggcaaaaccccgtctctactaaaaatacaaaaattagctcggcgtgatggtgcgcacatgtaatcccagctacttgggaggctgaggcaggagaatcgcttgaacccgggaggcagaggttgcagtgagccgagattgtgccactgcactccagccagggcaacagagtgagaactgtgtcttaaaaaaagggaaaaaaaaaacccaaaacagaattcaattttcagggaatgtgcctgttaagtagtgcaggattattttttcaaaaatagagagcacctacttatgttgctgttaatgagaccatcaactggaatagatcagcgtttgccctcaaagaacccaccctccagtgaggggatggtgtgagggctttggaggacaattctctcacctggctggcaattcctggggctcaatgtttatagaactgtccctcttttcatgagtgaacatcaggtgactgttccaagctgcaaaatatggggaacaaacaaaagatcgcaagagatcacactctgcccacacgccttgcaggtctcaacatcagcctctcctggttacagctgagacagccttgattgctatacaggaatcaaatgaggggagcttaacggcccatcaatcactgccaagcacacgtgtgaatgaagcacgcacgaagctgaaagctgcatggtaatcaacagagagtggctcattaaaatccattaaatttcctaagttggaaattgattgctgtctctctgcacaccatctaaatctcatctgacagctttgtctgacatcatttatcacttgcgacaaaataccaaaggaaaagaggatacacctttggccaaattatcccactttaggtctgttctttctgcctgtgtggaagtattgcacgctctcttagcagatgaacataaaagagaaggtaaaaatattctcctttcagatataaactaaaacaaaaaatggatcagacctccaaaggatcatttctcacaaaggccgccattctataaccagaagtcttttggcccacacaattttcgagtcagatatacacgaagtttcttctccctgagcgtgcaacaaaatgcaaacgcccactattgaaaaatcctgtggggtgttcagaacgaattgaatgtcatcattaagctttgggcctgtggacccctagaaggctgaaggtttcagagagagatgcaaatttaaacatatcagggtccagatgtctggagggtattgtgtattcatttacttgtctattcgtgggtactacgtccgtattcacctctttttagttgggttgagcttgagcaaatagcgtcaactctgagtgtgtctttctttctttctttcttttctttctttttttctttctttctctttctttctttctttctttctttctttctttctttcttttttttttttttttttttttttttgagacagggtcccactctgttgctcaggctggagtgcagtggttccagtttggagtgactgtgaatggagctatgagcaatcacagctcaatgcagcctcagcctcccaggctctggtgatcctcccatctcagcctcctgagtagctgggaccagaggtgtatgctaccatacttggctaattttttacttttttgtagagacggggttttaccatgttgcccgggctgttctcaaagtcccaggctcaagtgatccccctgcgttggcctctcaaaacggtgagattacaggtgtgagccatcatacacggccctgtatttcttcacctgtgtaatgagaataataatatgaccttgcttcttgcagatgtgacaatcaaatgagataatgcatatagaatacttagtttcatactttgcacatacaagggtctcagtaaatattcggggttttttgtttgtttgtttgtttgtttttgaggcagagtttcgctcttgttgcccaggctggagtgcagtggcacgatctcagctcacttcaacctctgcctcccaggttcaagcgattctcctgcctcagcctcccaagtagctgggattacaggcatctgccaccatgcccagctaattttttgtatttttagtagagacggggtttcaccatgttggccaggctggtcttgaactcctgacgtcaggtgatttgcccgccttggcctcccaaagcgctgggattacaggcatgagccaccacgcctggcctcatctcctttctttggcctctttttatagcgtgccttccagcagacacactcattacccctatttaccagtcctcttttgtggctgtgtgcctgtaattctcagtcatattgcagtattgcttttgctctttcctttactggttcctagtgtcataatcacacctaagatgccttcaggatctttcttgcctccgctgggaatgccgagtgaacctgcacaggcttggaatctaggtgttcaagccagcctgaaattggctctcaattttgctgaacctatcagcctcagatccctggtgctgatcaaagtggtttttaaattgtaggtcttgccatttggcagtaactgggccttgtcaaataggaaaacgctgggatggtgatgacttgagcccttttgtgaataaggagcacttcccttctctgctccttattgaaaatgtcacgagctttattgcctaagtgttaaagcgcggggacgaagtgggaaatcactttaacttccattcagagaatgttgtattgcctgcctatttctggagggcataaaagggtagctggctgcaaaaaaaaaaaaaaggtatattttgcagatacaagtcccaaaaagcctagttgccattttgcattggatttcttaacggccaaagcctaaaatgagtataagaatgtcttcttggtatagccttttcattgctacttggtcaaatatgctgggattgtgatataacttaatataataacgtaagttgataagtaagaaaatgagggtgtttgcttagtcagaataagttagtttcatatcagaagggtactgttttctcgcaggattaagtaactgttaagtcttgggattggaaggaagcaatcatttatctaaatgaatctttataggagatccttctcaaatgactatccaacctgtatatatagtgataaccactgcctagaaactctgtcttttctcggacagtacattgtatctgttctgtgccccattaggaatgggttgctgggccgggcgtggtggctcatgcctgtaatcctagcactttcggaggccaaggcaggaggatcagttgagtccaagagttcaggatcagttgagtccaagagtttgagaccagtctaggcaacatggtgagaccctctctctaccaaaaatcaaaaaattagctgggagtggtggcatgagcctgttgtctcagctacttggaaggctgaggtgggaggatcacttgagcccaggaggcagaggttgcagtgagccaagatcataccactgcactccagcctgggtgacagagtgagaccctgtctcaaaaaaaaaaaaaaatggtcctacagtagcctgtacccattggccccacacctaattcaatgggacaagtcagaattaatttacttcccttctacctgacaactcataaaatatttaaagaaagcttttgtgttttcactgtctctctttctcttctccgggataaacttccctgttccctaagtaccatcctgtttacctttttctgataatgctatgttcagatccttattcctcatacaaagaaacatcccaaattgaataaagcatggtagattctgcatgatagtaagccttaatgaattatgtttttatggcttgaatgtttattaatatgtgtcaggaggagacactgtcatgatttatttatgtatgtatgtattcggttatgtacactgtaccttgattaaaaaaatacttagtctctgacaagtatctagaccacattaagataaaacggtttgttagaaagaaatcaggacaaaaggcaaatgaaagtaggaaagtaagatgatgctgaggagaaggttaataccgagaatgcatgtcagacacccagtgccctgcttgctaagagcctgggcaaagggtaacactaattagttacagggttcacaggctgcaaaagataaaaacaactccagtactcaagagaagtgctgtataaccatttctggtgctgaaacgtttcttctttgactccacatgaaggggagactgaatgaagtatttggagatataatttccaaaattcatcctttaggtgtgcagttctatgattttttttttcttttgagatagaggctcactctgtcaccgagactggaatgtagtggtacaatcatagttcactgcagcctcaacctcctgggctcaagcaatccccctgccttagcctcccaagtagctgggactacaggtgagtgccactataactggctaattaaaaaaaaaaaaaattgtagaggtgtggtcttgctgtgttgcctaggctggtcttgaactcctggactcaagcaatcctctcacctcagcctcccaaagtgctgggattacaggtgtgagccaccacagccagccacttctatgtattttgataaaacttatgcactcatctaactagcactacattaaagatagagaatatttccatcaccccgggtcccggcacggtggctcacacctgtaatcccagcactttgggaggcggagatgggcagatcacttgaggtcaggagttcaataccagcctggccagcatggtgaaacctgtaatcccagcctcttgggaaactgaggcacgagaattgctggaacccggcaggcggagggtgcagttagccaacattgcaccattgcactccagcctgggagacagagcaagacttcatctcgaaaataaaagagagtatttctgtcactccaaagaaggcctcatgtacctttggagtcagtagccctagtcccagcccctaggaactgctggtctgatctcacttcttgtagttttgcatttttcaaaatgccacagaaatagaatgaaacagtatataaccttttggcctggctttttttcattcagtataatgctttcaagattcatcagtgtggatgtgtgtattacgagtctgtttcttttttttgttcaggagtgtactaccatagcttacactctgtgcatttatcccttcactagttagtagacatttgacttgtttccagtttggagtaactatgaatagagtcgctataaatattcatgtacaggcatttgtgtgggcatatattttcatttctctcaagtaaatacctaggtgtgggattactgaataaaatgagaaatgtatgtttaactttatacagagatgccaaaatgttttccaaagtggtgataccatttttaattcctaccagcaatatatgagagttccagttgctttacatctttgctagcaatagatattcttagcttcttttgttcgcttttaaattttagcctgtttaataagtctacagtggcatctcattgtggtttttgtttgctttcttttcatttactttagtaaattctttagtaatatgtatgctcaaatcttcccctttttaaattgtattgattgctttcttattattgagtttgaaagttctttatattctttattctgggcacagacttttttcttttcttttcttttctttctttttttttttttttttgaaacagggtctcactctgtcgcccaggctggagtgcagtgacacgatcacgggtcactgcagccttgacttgggctcaagcgatttttccacctcagcctcctgagtaactgggactacaggcatgcaccactgagctcagttaatttgtttgatttttagtagagacaaggtcttgctatgtttcccaggctggtctggaactcctgagttaaagccatcctgacttggtttcccaaagccctaggattacagacatgagtcatcacacctagtcaggtttctttaacaggtatttgttttgtgatattttctgccatattatatctcgtgtgttcattatcttaacagtgatttttgaaaataaaagttttcagttattgtgaagttcagtttgctatttctctccttcattattcatgctttatgcatcttatctaaaaaatctttgcctagataaaggctttctctgttttcttctgtatattttatagttttaggtttaatatttaagttgtttccattttgaactgtttatccactacgttattggaataaacaagtgaatgggtttcaaagatatgtttcctaaacagttctcaataaaaaccaatgacatcatggcaaagaatattccagaaacagcttctactggggaagctgaacaaggacatatctttctgttgttctgacagaattcaatgataaattttagagtgtctagagaaagcctcttcatttggggggatttacaacttacaaagttgcatgtaaaattaatctagctttaaattttctggaagagaagaactataattttcattaggctttcaatgggggtagtgaccaccacttgctccccaaaacgttaagaaccatggtattagtctgttcttgtattgctgtaaatacctgagactgggtaatatataaagaagagaggtttaattggctcttgattctgcaggctgtacgggaagcatgatgctggaatctgctgagcttctgaaaaagcctcaggaaacttacaataatggcagaaggcaaagaggaagcaggtgcatcttacatggcaggaccaggagcaggagacagagagagaggagggaggtgccacacacttttaaatgaccagatgtcatgagaactcactatcaagaggacagtaccagaaggatgatgctaaatcattcataagaaatccacccccatgatccagccacctcccaccaccccacctccatcactgaggattacaattgaacatgagacttgggtggggacacagatccaaaccatatcaaacattgacctagggcaggattccacagaccaaggttcacaggccatgtccagcttgccacttattttgcaagtaaagttatactgcaacatagccacactaatttgtattgtccatggctgcttgctttatggtgacagagttgactgtagagttgaattgttgggatagaaactacaaggagcaccagaactatttgttatctggtcttgcacaggagcatagacagactgtatatccttcaggttaacctgcaaaatagaaattgtctcagctgatttttctattgagtattgtgtagattgaatgcaagattatactccctggtagtacttggagggcagaagtgtggtgttgatggttttgcaaaactccatatttcaacagtgaaaagctctaagaagcaccgctactgtccttttctacaggaagaagaccaagaaagatcctctaggcttttaaatactaagttatctttgtaaattatttaggaatcactcaattgagtgatactggggcatctttttatgccccagaacatagctgcaataattttaaattgtgaaatattttaagtggtcactaccatatgcctaactttgaactttcaccaatatatcttttggttgtgcatataccatatcagttgaaaaatggatctcttttaaatgaataaggtaagtccctatgtaggaatttagctatacaccatttaagtgcatttaatgtttgtttgtttgtttgtttgtttgttgttactgtttttcaaatagcagctctgaagcccttctttgtagaatgaatgagatacctattaaagtcactcctggcttatgagtataaaattatgtcatctgcaagtgagaggaagcttttagttttccttacagaaggttggcaccttctttctaggactcacactaaagattgtgcttttccaaaagtagtatcttagtatctaaacaattaaagggatactttttaaaaagtgaggctgggcatggtggctcacacctgtcatcttagtactttgggaggctgaggcgggaggatcacctgagcccaggagtttgagaccagcctgggcaacataacaagactctgtttctataaagaataataaaaagtttagctgggtggggtgacatgtgcctgtgttctcagctacttggaaggtggaggcaggaggatgacttgaacacaagaggtagaggctgcagtgagctacgatggcaccactgcactctagcctgggggacagagtgagaccatgtctccaaaattaaaaagttaaaaataaaacgtgagccagaaaacattcttattttcccctgaatcctcaaaaacggtctctactaactcaaagtctggcagtgtttttaaggtgctgattgtgagctcagcccaagtcagtgaaaccatctattccttacagatttcttcatggactgatagaacattacattggtcagtattggaagactcttacccaaagcccatctcattcccaacatttcttgcaaagcccagacttatcatttatacagagggaaacaggcatgcatttttaatgaagtgttcaataagttaaatatatctatactttggaatgaaataaagggttgttcctttttttgttttgttttggtttggtttttttttgagacagagtctcgctctgttgccaggctggagtgcagtggcgtgatctcagcgtgagccactgcgcccagccggttgttcttttgaaaatgatattaatgatcttgctgagagctatctccaccactcaataaaaccttacactcattctccaagcccacatgtgatccaagttttccagtacactagggcaagaacccaggatacagaaagccctctgtccttgcgataagcagagggtctaattgagctcattaacacaagctgtctgcagacggcaaagctgaaagagcacactgtaacagacgcccaccaaggcttcaggagctgtaaacactcacccttagacactgctgtggggtcagagcccaaaaatgctccccacgacccctacacctgcctgtctgcatgcttccttaggagtttgagcagcagggcagcaaagaagagtcacaaccctgtcgcacatcctgtgacgggggataaaggaacactcccatttcagtgtccatccgtaggggaatgcgtaagccaaagtatatgatatgacatacttagcaacagttcagatgtacatacatagcagtgtggataaaccttaacaatgctccctttagtcaaaaaagaaacaatgagattcatagcaggaaacatttatgtttaaatacacggacattgaaaacaagacatattttggggacagtatatcagaggggataagaatatgaattcctcagccaaacttcataggtcctaatcccagctccactatttacctcttatgttagatgagttacttaatttttgtgcctcagttttcccatttgcaaaatggtgataatctcattgcattgctatccagatttgatgagttaatgtacgtgtagcatttaaaatatagaataagtgctaataagtgtaatctattattgcagtacatgtatcagtattacatataaaacatataaagtggtgaccaagggggtaagggaaaaaaagtggaatttggggaccaaggagagacgataagaaaaaaagaagagaaaaagtttcctaggctgggcacggtggctcatacctgtaatcccagcactttgggaggccaaggtgggcggatcatttgaggtcaggagttcaagaccagcctggccaacatggcaaaaccctgtctctactaaaaatacaaacatgagctgtgtgggctgggcacagtggctcacacctgtaatcccagcactttgggaggctgaggcaggtggatcacgaggtaaggagatcaagaccatcctggccaacatggtgaaaccttgtctctactaaaaatacaaaaattagccgggcgtggtggcgtgcacctgtaatcccagctactctggaggctgaggcaggagaatcgcttgaaccagggagtcggaggttgcagtgagccgagatcgcgccgccgcactccagcctgggtgacagagcaagactctgtctcaaaaataataataataataaaaataacaaagtttcttagagcttactgtttagtacaggtgaccctaattttgtgacactagcaagagtaaactttccaggtttacctggtaactgagattccaaaacttaaataccagttacaaatcttggatacctatgtttaaacctgtcctctttgtagtatttgaaggccaaactgagatccttatatatgagaatttattatacttgaatctttcaaggttactagaatttgagtaagcgttgaattgatgagatcccgctgatctcttctgatttcatttttccttgttactttgttcatctcaccagggattgtcttttttctttttggcctggcaattcctgacagatcaggcactagaaggaaaaaagacccacatttgctgtgacatactgtagataaaactggtttaaagctttcagcaatttgtagaaaagatgtggaagagaaatcttctcctcacggcacccaaagtggaattttaaaaggtattagataatgaaaggtttctaggggaatttgaaatcttcttagtcagtctcacactttctagccccctgagctcaccagtgtgaaaggttgagatgaggggaaatattcactctctatatagtccagaatgtccattcaaacggtagcaaatgcagagggctcaaatatggcatggcttttgccagcagttcgcagcatggactcggtattggtatttgttacaggtaattggcttctgctcacattaattaatttattggaggctgggtctctctctttcacccaggctgcagtgcagtggtgccatcatagctcactgcagcctcaaactcctgggctcaagtgatcctcctgcctcagcctctcaagtagctggaacaacaggtgcatgccaccaggcatgactgattttttaaacttttttttttttttttagagatggggtcttgctgtgttgcccaagctggtctcaaactcctggcctcaagtgatcctccagccttggcctctcaaaatgctgggattgcaggtgtgagccattgtgcctggccacaaggttattcttataataactttcctatcttgcacttgcatcttgttttatgagaaaacggaatacgcagatacaaatgaagagatgatggacatagggtaggcaggtgaaaggaacaaacaagatataatgaggctccctgaggctacaatagctggaaattgttcccactccaagggctgaagggaaagggttactggaacctcacgaggtctggaagaggtgccactcagcgggaaataggcttgtgaagagacatagctactgccagagtagcagagttttgtcagaaagtatgcaggggaggaggaccctgccctctctcttctgctgcccttgaatttcttgccattgtctgaattggcctaacccaaacagaagctagcagcaagtttgtctaggagatgcaatctacagagatcagtttccaagggcccagggcagagaggtgcagggagggaatggcttgtggagatggcaaatggagaattgcgcacacacattttcttattcctttttgtttgttttaatagtgagagaaagaagtttgcagatttcatgtaacagtacccatgggagtacagtacacaagtgaacgtaatctattacgggttttatggcagaaaagagattggtaattactggtctatggggctgactcccaagggggaaatacaggtaacattttcatcagctagatctcatgtgctaacattaaaacagaactgggttttatgtataaatacatttggtagggaaatttctattaggatgtaaatatctgtctttagaagaggggatgtaagctcggtttgattccttgtctgtcttgtttgctattgtatacccagtatctggcacagttcctggcattgtgaataaatgaatgagaagtaatctttcagataccttatgtattataggtatagactaattggactgacaatgatagtaactttgctgattatgtgaaattcatttaagataaaaagtcttatgagcagtggctcatgcctgtaattccagcactttgggaggccaaggcaaacagatcacctgaggtcaggagttcaagaccagcctgggaaacatggtgaaaccccatctctactaaaaatacaaaaattagccaggtgtggtgtcacaagcctgtgatcccagctactcaggaggctgaggcacgagaatcgcttgaacctgggaggtggaggttgcaatgagctgagattgagccactgcactccacctgggcaacagagtaagactctgtctcaaaaaacaattaaattagaataaaataaaaagtcttaatatcacgaccaggtaatggtgtaggagtttgcacctgcatggaggtagagagtggaagaatataactattaaaaaagatctaaaattagaactgccattcaatccagcaatcccactaccaggaaagaaatcattatatcaaaaagatacttgcactggtatgtttgttgcagcactattcacaatagcaaagatatggaatcaacctaaatatctatcagtggaggaatggataaagaaaatgtggtacatagacaccatggaatactactcagccataaaaaagaatgcaatcattatcttctgcagcaacacggatggaagtggaagctactatcctcagtgaaatagctcagaaacagaaagtcaaataccacatgttctcacttacaaatgcgagctaaacaatgggtacagatggatgtacggagggaatgatagatactggggactccataaagggagaggctgggacggaagtaagatttgaaaaattccctattgggtacagtgtacactgtccagatgatgggttcatgatgcaatatatacatgtaagaaacctgcatttgtatcctctaaatatgcttttattttatttttttattttattttatttatttatttatttatttatttatttatttatttatttatttatttttgagatggagtctctctctgttgcccaggctggagtgcagtggtgccatcctgactcactgcaaccaccacctcctgggttcaatgattctcctccctcagtctctagagcagctgggattacaggtgcccgccaccacgcccagctaatttttgtatttttagtagagatggggtttcaccatgttgaccagactgatctcaaactcctgacctcaggtgatctgcccgcctcggcctcccaaagtgctgggattacaggcctgagccactgtgcccggcctaaatatgcatttttaaaaaagaatacaactgtgaagagacatcacatttggtttgcccaggaattgaaatagactagaactagaaatagattctagtcctatgagcaccatggagtctgaccactgtcctcttgtgctgatggagttgggactgggtgaccatcgtgtctcacctttgctgaaagtatccaccacacatacccttcccccacttaaaaaaaaaaaaaagctggaaaggtaaaaaagtcaaaaccctggaatatgtagagatgtcctaaactccaagtctcttctatctatatcatgttaaaactcatcaggagaactggtatacccctatgctctatgctctgggaaaggaacatagtcgttttggtagatgttcctgggagaaggggaagcccattttcctttcctcaaaaggacttgcctctcacccatcttaggaaagttttccaaatatataaaaacaaccaagtctggattctccaatcctgtgtttgcgatctccaagaaagaacagaacacacttctggacaacttgtccaaacttcagaactgatcacaatgttgctagccacattatgtgaatattagatttcatgttagcttgtcatttaagaccaggcagaagggaagctcctcctgaaccatgagacctgactcatcactgcctaccatgacaggtgcttcactgctactaagtctggtgaaaaggagaggggcaagccattcagtttgctttctctcctagcctttgatagtgccacagcttccagaacatccttgctttaattgagcagcctatgcctatcttttataactaacaagtgacccaaaatacaggcatgtgaaagcctgatactccaggtttcccgtcataaggaaagccactcggagaagtcaggcagcatgttggaaagtgatctgagggtctgatctgtcagtcaagaaagaactctgggcaatgtctgttgtgaggctgggtgggagactcagtctgttaaggtagcagtgatgggtcaggtctcacagtgcaggaggagctgcctttctgcctgattttgaacaagcagctaacatgaaatctaacagaagagaccacataatgtggctagcaccattgtggtcagctctgaaggatggcaacgcaagttgtccggaagtgtgtcctgttctttcttggagatcgcaaacataggattggagaatccagactttgctgtttttatatatttggaaaactttcctaagatgggtggagaggcaagtccttttgaggaaaggaaaatgagcttccccttctcccaggaactgtatataccacatgtgcctgggcaaacttggtagtctattggtactttgtgaaggaccaataaggtctttgacagataggaagactacacaaaggggcctccctgagttgtctgttgtgtcttacaatgaagacagggaactggaggaagccaagagtctcatgagacagagaatggatcaaactaataataagctcattttaacaagaccagtatgagaatagggcaagaaacctgacaaacagaggggaacagtagatactggggactccataaagggggaggttgggagaggtgagatttgaaaaattacctgttgggtacaatgtacgctattaagatgatggatccattaaaatctcagacttcaccatgatggaatataccatgtaagagattggtaattactgcactttctttttttttctttttctttttttttctttctttcttttttttttttttttttgagatggagtttcactcttgtcacctaggctggagtgcaatggcacaatctgggctcactgcaacttctgcctcccaggttcaagagattctcctgcctcagcctcccaagtagctgggattacaggtgcatgccaccacgcctggctaatttttgtatttttaatagagatggggtttcatcatgttggccaggttggtctcgaactcctgaccccaggtgatctgcctgcttcggcctcccaaagtgctgggattagaagtgtgagccaccatgcccagcagaaacctgcactttcttagtgcgaggtgtgagccacagcacccagcctaaatttttcagtcttaaaatgagaacattcctagtttcttctccttcttcaaaaacaaaacaaaaaatccggagaatcacctcacttcatgcctgtctaactcaccggaaaattgcattaatctgtctgagaactgaagttacttaagagatttgccatttgtaagttgaggaaggcattttaggtttgcagtgatcagtacaggcgacagatcgtaatggggtagagaaagagtgtcaaggtttgagagtggtgtcttttttggggtttgattttttgcagagtgaaatatttcatctctgagttgcttactacgaaaagagtgtctttgttttatttttttaaacctctttatttcctttttaggcttttgtatcagatttcatcacgtttttgtctttccagaatcattaatgataaattcttacagtcaagaaaaatattagatctaaccaaaaatttaaaagtcacagtcccacccacctcctatcaatctttctgaaagaagtaaatcaaaattctctcacagaagatgaaagtgaattgtccatcaaagccgagagtggctgcttgattacttcagcatccagaccatgtcttcggctgcgatagaaacaagatgattaatttcagagcttctctcggtgtctcatttcgctttcaccacctccccaccaattcataaagctcccgtgaagggagatgaagggattgactatcaaaaaaataaagtatagggctgggtgtggtggctcacacctgtaatcccagcactttgggaggccaaggtgggtggatcacctgaggtctcgagttttgagaccagactggccaacatggtgaaacctcacctccactaaaaatacataaattagccaggcgtgatggtgggtgcctgtaattccagattctcaggaggctgagacaggagaatcgcttgaacctgggaggcagagattgcagtgagctgagattgtgccactgcactccaacttgggtggcagagtgaaactctgtctcaaataataaaataaaataataaaataaaatgtaaatgctcctggcttgctgtgtgcctgcactgctacatacaatcaaaactttaaattgggactggacacagtcagcccctgtaatcccagcactttgggaggctgaggctggaggataacttggggccaggagtttgagatcagcctgggcaacataacgacaccctccctctgtttaaaaaaaaaaaaaagttatcagaacaaaaataataataatttttaaaaaaaatactttaaattgaaataatgcccaatagtaaaatttccgggcactcttatctgcagtctttctgtagctcccaagtcctcccctacagcatacatatgtgccctcaatcatcctactcatcacaaaaggaaacaaagttcctttctgctattaaaattctagaacgggctgggcacagtggctcatgcctataatcccagcactttgggaggctgaggagtgaggatcgcttgaggtcaggagttcgagaccagcctggccaacatgatgatgctccgtctctactaaaaatacaaaaattagctggacatggtggcacatgtctgtaatcctagctacttgggaggctgaggcaggagaattgcttgaacccaggaggcagaggttgcagtgaaccgagatagtgccattgctctccagcctgggtgacagagtgagactccatctcaaaaaaaaaaaaaaatccagaacatacatggcccagtctatactatctcggttgggggctttcagtgaaactgccggctctgagatcaccaggtaccacccaggtgccagactaaatagcggcttttcaatcttcagccctcaagccctcttagagtacattctacttctgactttcctcccagaggaggttgtctgtctgcttggtctgaaataagtgcatcatagtcaggtcatgttggaatctgactccttccaggacggatctcctgagttccagaacatcaggggcttattgagccagggcatgctcaaaacttaagatctgtaccctatattacctctatgttgatcagttttttaatctaaggaaggcaatgcagtatgttctgtaatattttccacttagaccagtggggaaagcgttcattttggggttcaacagacctggatttgaacccctgctgtgccattgacttaagtgtggaatctctaaattcactgattcttgcagttctcacttagggagtaggggtcatattgacctcaaagagcattttgagatttaaataaaggaacgtatgcaaaaagttgatcagcttttcaacctctccgctgtgtcattcccattagaatactgatacagtttggctgtgtctccacccaaatctcatcttgaattgtagctcccataattgccatgtgtggtgggagggacctggtgggagatcactgaatcacagggacggtttcttccatactgttctcgtggtagtgaatacgtctcacgagatctgatggttttatcaggggttttccgtttcgcttggttctcactctctcctgcctgccgccatgtacgatgtccctttgcttttccttcgtcttctgccatgattgcgaggtctccccagccatgtgggactgtgaatccattaaacctctttcctttacaaattacccagacttgggtatatctttattagcagtatgagaagggactaatacagatacaaacatacttagacaactctcatcctaaaaaacaacattccacgccttgtaagatgtgggtaaaataaataagaagaataatagtcaaatgaaactgtctgttcccctgtagagaagagttaaacctcactcctcttcactgctctgaatcaaccccccaggtagtagtctgtactcactgctgccagttctcttctcccactgactcctgaatctactctgtcttgattttcattcttaccattccataaaacaaaacagctctagtggaggtcactgatgaccaccatgttgctaaatcccacagtcaattctcaatccgtatcttctttttaatgtttgagacagggtcttactctgtcactcaagctggagtacagtggcgtgatcacagctcactggagccatggcctcccaggctcgtgcagtcctcctgcctcagcctcctgagaaggtgggactacacatgcacaccactatgcccagctaatttttattattatttttaattttttttttaattttaagttttcgagatggagtctcactctgttgcccaggctggagcacagtggcacgatctcagctcactgcaacctccatctccctggttcaaatgattttcctgcctcagcctccctagcagctgggaatacaggtgtgtgccaccacgcctggctaatttttttgtatttttagtagagacagggtttcaagatgttagccaggctggtcttgaactcctgacctcacatgatcagcccctcggcctcccaaagcgctatgattacaggcatgagccacagtgcttggccccattttaaaatttctcatagagatgatgtcttgctatgttgcccacgttggcctcaaattcctagcctcaagcaatcctcctgcctcagcctcccaaagtgctgggattacaggcgtgggccactgtgcccagcctttacccctgattctctagcaatagtgaattcattgcagttgttccagtaagccagattctcaggttctcttttctttgagagactgagatcatgttttttttgtccacactgccaaccaccaaccccaccttgcctgcctagctctccctgtctatgaagacatttcctagctgcctccctcaccccccaggagacaggtgcctcctatgttcccctgtagaaacatcagcccagccccatcagagcatctgccccatgacatggaaactggtcctctgcttgtcagtctctgcaaagtcctgctggcccttgggtccccactcccagcacaatgcctaacacataaatggcactcagtaaatatttatttctcaggaaactttatcaacaattattcaaaacacttttacacacatctcaaaagagctattatgaaggtaaaatgctgttaataggcgtgaaagcaccttagaatgcggaaaacaccagaaagagaatatgtatattaaagcagaaaattggcttttctccaaagccttgacagtatataaaggagaagaagaggtgactatatctttctcctgccaatgagacagcaattcgagtggcctggagtggtcatttaagatgataaatccattcttctaccacaagtgtgtgttgatacgcatctacttaaatagtgcagggaacaaggccatatggaaaatattaagatgaagaacaggatggaggagagaagccgtgggcaccaacagattaagataaagtgtggaggactgaggcagctgtggtggctcatgcccgtagtcccagctacttgggaggccaaagtggaaggcttgcttgaggccaggagttcaagaccaccctgggcaacataacgagatcccgttcctgcaaaaaattaaaaacagcagctgggtgtagtggtgcgtgcctgtagtcccagctactcaagaggttgaggaaggaggattgcttgagcccaggagtttgaggctgcagtgagctgtggtcacaccactgcactctaaactggatgacagggcaagactttatctccaaataataaattatggaggactgagtcacgaaagccatgcaaaaggcatttatgacaagctaaagaggaaggcactttctcctattagaggaatcgaagaagactttctggggattagaagaagctggacaggtattgatgagctttgaatgtgaaggcaggaaggatgcagggatcctacaggggccgagccgacaagagcatggtggggcttggttttagaaaaaagaattcagcagattgtgcaagagggaacagcccggcacctggggcgtccgtatggccgtacttgtaatagtccaggaatgagttgagatcgctagcgatctacactagctttcttgggtcatgaaagtaatgcagccatggcttccttgggtcacggaagtgatgcagagattgagcatttggaggaccgatcaaatcagcttttatgtgccgctagcctcaaaaagggagcattgccgcctggccaagggacaagcctatgtgggccccttcccctcacccagagccgagtccttgtggcagagcagctccttctctgctgacatgcacgccttccctggaccaactgtggagttattatcatattaataccaacatcttcctcaggcaaggaggtgaggggggtgcacttgggaaaggcagaaatgactgggagccactgagccgctgttgaggcgtcagggtggagccaagaatgggaggaccctaagcatgaaagtttcatgatttaggaagatcctgccaggtgacctgtggtatcttcaatttagcagttgcaggtcgcatatccaattcaacagatcagtgatttgatagagatgcaagaaggaagctgctgggcagactcttcatttttcatacttcagctagcaactgtttctcttgaagatgtcccagaaagcagactcactcacatcctggggtggtcctgcctggttctccctccaccatcagcagccgcatctgttggtttgggcaagtgatggattggttgggtctgactcccaggaggggaatggaaaaaaaaaaaggctgcagcagtttgacaaactagagcacagaaaaagtgcaagacatcagaagatccaccattctgcaagtcgcttgcatgatttcaaagtcaaagactttgatttcaaatcctggctcagggtgagccaaccagaaccagccactgagccatagatgccaggtttctggctgtgatcagttttgtcttagtagggtatgtgacatctgccaatccaaaaagtatatttagagatgctatagcagaccagactcctcactgagttcttgcagaagctggaaaaacttgtttctgttattcgttttttgttgttgttgttgttttgtttttgtttgtttgttattgagatggagtactgctctgttgcccaggctggaatgcagtggcatgatctcgactcactgcaacctccgcctcctgggttcaagcgattctcttgcctcagcctcccaagtagctgggattacgggcacgcaccatcatgcccagctaatttttgtatttttagtagagacggggtttcaccatgttggccaggctagtcttgaactcctgaccttaggtgatgcagctgcctcggcctcccaaagtgctgggattacaggcatgagccatgcgcccggccgtttctgctattctttactgtaagtaaaagcatttctttactgagagtgttttctggagagtacatggtgttagagagctctttgatcaaagtcccttatgccatataaaaagaaaagggtgttgtgccctagaggcagctatgctgtcatcttttgactgagtaattaaactgatatttactaagagcctactatgtgtccagcaggtttcaggcactggccgtgaatgagagagatggggcagacaggcaataaatgaacaaacaaggaaatgtcatttatggataaatgttatggtagaaataaaacggggatagacgggggcctattcaggaatgcctggttagggcaggcttctcagagagggtgaaatggctaggaaaggaatgacagggtggagccggctttatgaagaactctgggaatggcattctgtgcagaaggaacagtagatacaaagtcctaaggtgggagcagcttggcatgttcccagagcattaagaaagccagtctggctggagcagactgagggagactggctggtgccagatgtgcagtgggctgatcaggtaggagtatggacgtgattccctgtgtggtctgaagcagctttaagtttaaagaggtgtgttctgactggatttacagtttcaaagtctgactcgggtggctctgtggatcgggggtgttagggacaaaagaaggacttgactactctgggtcagggaggaactcagtatgagctgtttggggccagagtggtggggagaggatcagttcgggctatgcttgcaagtctttaagaggaccgtggtgatggattggtcataggaatggggtgttgaaggaagacacagaatcaaagatgatgcctaggttttttggcaagtactctgcaatatccaaaaatgcgtggtagtgattgtcggagacctagatcctattctcaacccttccatgtatctgtgggtgaccttgaatgagtccctctgcctcagtttcctcacctgtaaaatgatggagttggaacagattacatgaaagacccctttccgccctgcccatacttgtgctgtggctaaaacaactgtgagcaattctcctcccataaggggctcactctccaggtgttaccaggggagggtgtccaggttcttggcatctcgaacaaagaattggacaaaatgcacaaatgaagcaaggaaggaatgaagcaacaaaagcagagatttattaaaaatcaaagtggccaggcacggtggctcacacctgtaatcccaacactttgggaggctgaggcaggcagatcatgaggtcaggagattgagaccatcctggctaacacagtgaaaccccgtctctactaaaaatacaaaaaaattagccaggcgtagtggcaggcgcctgtagtcccagctactcgggaggctgaggcaggagaatggcgtgaacccgggaggcggagcttgcagtgagccaagatcgtgccactgcactccagcctgggcgacaaagcgagactccatctcaaaaaaaaaagaaagtacactccacaggttgggagcaggcccaggcataggggctcgagagccctgttacagaattttttggggtttaaataccctctaaggctgggtttggtggctcatgcctgtaagctcagcactttgggaggccggggtgggtgaatcacttgaggtcaggagttcgagatcaccctggccaacatggtgaaaccccatctctactacaaacaaaaattagccaggcacagtgatgcatgcctgtaatcccagctactcaggaggctgaggcaggagaatcgcttgaacctcagggagaggttgcagtgagctgagatcacaccactgcactccagtctgggcaacagagtgagactccatctcaaacaaacaaacaaaaaaccctctcgaggtttccattggttacttggtatacgccttatgtaaatgaagaggatgaagtaaagttacagtcacttactcgacgtacaccctttgtaaatggagaggatagttctgtcatagctgaagtgtttccatttgatttagctctaggaagtccttatgttccctgtctccaaaccctattctcctgcctcatagcctgtcagggattcgcttccttactctgaatgtccacaatatttatggccattctttcagtccagaccgcactgtcatagtgacaaactggcagcatggaaaacaaattcttttttttttttttttttttttttttttaagagacagagtcttgctgtgtgactcaggctggagtgcagtggtgccatcacagctcactgcagcctggaactcctgggctcaagtgatcctcccaccttagcctcccaagtaactgggactacaggcacatgctaccatgcctggctattttttaaatttgtttgtaaagacagggtctcactatgttgcccaggctggtgtggaactcctgggttcaagcagtcatcccatcttggcctccaaaaacattgggattgcatgcatgagccactgcacctggctgaaaacaaattattattttttttttttttgagacagagtctctctctgtcacccaggctggagtgcagtggcatgatcttggctcactgcaatctctacctcctgtgttcaagcgattctcatgcctcagcctcccaagtagctaggattacaggcaatgcaccaccatgcctggctaattttttatttttagtagagacggggatctcaccgtgttggccaggctagtctggaattcctgacctcaggtgatccgcccgcctcagcctcccaaagtgctgggattacaggcataagccaatcgtgcccggcctgaaaccaaattctaatggagctcagtgtcacatgtatgatgactctctcttagaaggccatggcttccttgggtcatgggagtaatagagaaactgagcatttggaagacccatcaaatcagcttttatttgctgatttgatttgctgatcaaaaagggacctttgctgcctgggcaagggaagagactatgtggtcctcttcccccccactcagaacagagtccttgtggtggtgcggctccttctctgctgacatccacaccttccccagaccgattgtgagtcctcataatacaaacatcttcctcaggggtgctggctcaaggtaccttttccctgcatgcactatcgccctttcgatgagaagtctggcagataattatcacctgaacaaaatctgggcatcagtcccccaaaaatgcactgcccctctgtggatcttcctacatacctgcctccctggaaaagagaagaaaaaagcatgtccacatctttcttttttttttttttgagacggagtcttgctctgtcgcccaggctggagtgcagtgcaactagctcactgcaacctctgcctcccaggttcaagtaattctccttcctcagcctcccgagtagctgggattataggcaccaaccaccacaactggctagttttgtatttttaatagaggcagggtttcaccatgttggccaggctggtctcgaactcctgacctcaggtgatccacctgcctggggctctcaaagtgctgggattacaggtgtgagcctccatgcccggcagcaatttttaaaaattgtaactgcattatgagaacagtatttcaaggtgacccatttatgtggagatttttagaagaagaaaaaacctccagtataattttcttcacttttaagcccagtgatattttcagaaattcaagacataccatagcataggaaaagggtgtgtctagagagtctctggcttccatgtctgatctcattctcactatcagtatcatatcttcattgtactggattttaactcaaactgaaagatgccctctgattctctgtccatttctgtaaaattgccttagttcatgatgtggttgcattgcctgagataatgtacataaaactcccactggcggggcgcagtggctcaagcctgtaatctcggcagttcgggaggccgaggtgggcagatcgcctgaggtcaggagtttgagaccagcctgggcaacatgatgaaaccccgtctctactaaaaatacaaaaattagccaggcgtggtggtgggtgcctgtaatcctagctactcgggaggctgtggcacgagaatggcttgaacctgggagtcagaggttgcattgagccgaaatcacgccacttcactccagcctaggtggcagagcgagactctgtctcaaaaaaacaaacaacaacaacaacaaaaacacaactcccaccaaacgtggcttctgcatggtggttcatgcctataatcctagtgctttgggtcaaggtaggaagattgcttgagcccaggagttcatgagaagcctgggcaacacagcaactcacctaaagtttcaggtgactgaaaaacagcagtttccttgccatcactcacggcaccgaattcaaagtcaggaaatcctgattccagaccgtgtcaggtaccatccaatgccttacagtttattttccatctcaaggaggaaaaaaggccttttcatgcttgcctcatgacagatgtgggaaaatgatgtatgtgtatgtaacgttcttggctgtctaggcatggtggctcacacctgtaatctgagcatttttagaggcaaacgcaggaggattgcttgagcccaggagttcaagaccggcctaggcaatacagcaagactttgtctattaaaaagaaattagctgagtctgttggcgtgcacctgtagtcctagctactcgagaggctgaggcaggaggatcacttgagccccggaggtcaaggctgcagtgagctatgattgcaccactgcactccactctgggtgacagagcaagaccctgtctcaaaaaaaaaaaaaaaaaagaaagaaagaaatggaacccgctagatgtaaggcaacataaatttaggctaccattattattgtcactatttctataagaattagatttttttactcagggtcttgggaaacagacaaaaatagaaatgtatgaagatattctgatttccctcctttggagaaactttttttcttgttatgttcttcagctaattaaaacaaaatgagcccaacatctaccatttccctaagatccacaatttccaaaaatccttttggaacttgaattgcctagctaatccacaaagtctgcatttgagcttccaccagatgcagtccctaaagcggccctcaccccatgcctctgctgagcagaattccgttcatggggaagtccttcagaagcctgcccaggtcgtctctgccctaacttctctgaactctggagcagcggtccccaacctttttggcaccagggacctgttttgtggaagacagtttttccacagaccagtgaggaaggatggttttcagataatgcaaccacattacatttattatgtactttatttctattattattacattgtaatatataatgaaataattacacaacgtgtaattacacatcatgtagaatcagtggaagccctgagcctgttttcctgcagctagacgatctcctctgggggtgatgggagacagtgacagatcatcaggcattagattctcacaaggagtgcacaatctagatccctcgcgtgtgcagtttacaatagggtttgagcacctatgagaatctaatgctgctgctgatctgacaggaggtagagttcaggcggcaatgtttgctcacctgccactcacctcctgctgtgtagcctggttcctaacaggccacagactggtgctggtccacagcctgggcgatgaggagccctgctctcgagcactggcactctgcaatgcctatttcattctcattgggttgtgccttgtgttggtacttaactgcgttgttttgtgtatcttgttgacttaatgtcttagcccattttgtgttgctataaaggaatacccaaaactgggtcatttagaaagaaaagaggtttacttggctcctggttcctgcaggctgtacaagaatcatggcacccacatctgattggcttctggtgaggccttgggaagcttttattcatggtggaagggaagggggagcaggtacatcacatggtgagagagaaagcaagagatgccatgctcttttaaacagccagctctcctttgagctaatagagtgagaacctacttattactgtggggagggcctcaagacattcatgagggatccgcccctatgacccatgcccctcccaccagaccccacttccagtattggggatcacatttcaaaatgagatttggagggtacaaacatccaaactatatcacttagctagatttcagtgtagtcacctctagggaaagacgtacatgtgttttctcctgcctcctaactcttcttcaaggatgctgggagactggtaccacattggtagccaatttcttcatgagcacaaattcaaagattagacagagggtagcaattgtttgtaaacataacagattcttgacttcggatgtattaattcactgatttataattagtaattgactcattaagcattttgatagcaattagttttttaaagaacagcttagacacaataggtaaattattacataaattcagaaatgttttctttctttttttttttttttttttttttgggatggagttttactcttattgcccaggctggagtgcaatggcacgatttcggctcactgcaacctctgcctcccaggttcaagcgattctcctgcctcagcctcccaagtagctgggattacaggcatgtgccaccatgcccggctaattttgcatttttagtaaagacagggtttcaccatgttgaccaggttggtttcaaacctctgacctcagatgatccacccacctcagcctcccaaagtgctgggattacaggtgtgagccaccacgcccagccattgttttcttatttttttgttttttaaaatagagatggggtcccaccatgttgcccaagttgatcttgaactcctgggctcaagtgatccacctacctcggcctcccagagggctcggattacaggcttgagccactgcaccctgcctagcagcattgtttaacactacaaaaaccatataaccactgagctccttctcagaaggaagatggcgaaagctcactgctcaacagtgactagattcataacctggggctttggtctgtttgttttaggcttaactcttgcagatttggggaatgtcaggttccaaaacttgagttcattattcctgtcaattcagggcacacccttaccataagcccatgaaagacaccttgttgggttattttattattttttctttatctccatgctcactccccattttcatcctgcctatacatagatgtctttgaaaataaatattattgccgactccaatttaattttccaaggtcctgttccaagcacttttatacacattctcttctttcatcctcccaacagcactatgagaaacattgttttggcctggcctggtggctcactcctgtaatcccaacactttgggagtccgaggtgggtgaatgacctgagttcatgagttcaagatcaacctggccaacatggtgaagcccccatctctattaaaaataaaaaaaattagcccatgtgataacacatgcctgtagtctcagctactcgggaggctgaggcacgagaatgacttgaaccccagaggcagaggttgccatgagctgatatcgtgccactgtgctccagcctgggtgacagagtgagatcctgtctcaaaaaaagaaaaattcttttgttgttcccatttaacagaagaggaaacagaggcatggatatgtgaagtaattttcccaagatcatgcatttagcatatggcagcgtgaggactcgaatccaggctacataaaacctgagctctagcactctgcagtactgtatctactctatattttaaaatatactgtgttgtttcgcgtgtgtgttttaaaatgtatttgaatgttattgtgcaactactgtgaaaccagaaaatgtgagacaggtctcagttaatttagaaagtttattttgccaaggttgaggatgcacccgtgacacagcctcaggaggtcctggcgacatgtgcccgaggtggttggggcatagcttgcttttatccatttagggagacatgagacaccaatcaatttatgtaagaagtacattggttcggtctggaaaggtgagacaacttgaatcaaaggcggaagattggaacgggggaagggacttccaggtcacagacaagtgatacacaaacggttacattcttttgagtttctgattagcccttccaaaggaggcaaatcagatatgcgtctatctcagtgggcagagaggggtgactttgaatagaatgggaggcaggtttgccctaagcagttcccggctttaggtttccttagtgatattagtggcccaagatattttcctttcgtactacagatacccttctatatcataccttcttcattctacattatgcttttaagatctaatcacctgctaaagatatcactagttgatggatcgccacagagcattccatcacatccatccatctcagcttactctttctttttaatttgaagcacaaatgctttaaaggcgcatctcaattcccgtgtggcgggcaaaaaataaaatataggagcagatcgtggcacaccattcccaccagccaagtggtcaaaccccacatccaagacccagtgagcagccaagttcagcgcaacttccaggcctcttgctctgactccaacagggtgagcacgtccccctcacacacggggccttttacactgcggatgctggagcggctcgtgttgtccataaattccacgcgcacctgcgtgcagtgtccctgagagccggtcctgcccaggacctcggtgaccctggccagcttgataggctgcacgtggctggtgtccatgacggcggcgtggcggtctggcagagtcagttgactgttctgttttttgtttttcgtttttgagacagagacttgctctgtctcccaggctggagtgcaatgatgtgatctgggctcactgcaaccttggcctcctgggttcaagcaattcttctgcctcagcctccgagtagctgggactacaggtgtgcaccaccacgcccggctactttttgtatttttagtagagacagggtttcactatgttggccaggctggtctggaactcctgacctcagatgatctgcctacctcagcctcccaaagtgctgggattacaggcgtgagctaccgggcccagcccagttgacttttttatgtccctaatgaggggcagtcagaatgtctcccaatccctaatccccaaacattctaataaacattctcactcatggccccttacatacctgtgtgaatttctctagaatatatcatttggaatgggattgctggcatataaagtacacactgcctgttagattgatttctggcatgatgatgctaactaaccctcttcccagcagcacaaaagattcttttttctctaatttctcatgaacatttatctgactttataatttttaccaatttgatggttgtcaagtgtataccattgttgcttttcatttgcatttctctaagcatgaatgaaattgaacctctcttcataaacttggaggctgttgggtttacctttctgtgaatttcttattcatatattttgttcatttttgatactgggtctgctgtcttgttatctaggtaccatcaattttagaggcttcaaatattgccttctcagtcttccccccgtcagttaacttcatttatggtgtccttattgaacagaaattcttttttttttttttgagatgcagtctcactctgtcgcccaggctggagtggagtggtgtgatccaggctcactgcaacctccgcctcccgggttcaagcaattctccctgcctcagcctcccaagtagctgggattacaggcacctgccaccacacccagctaatttttgtattttttttagtagagatgggttttcaccatgttggccaggctggttttgagctcttgacctcaggtgatccgcccaccttggcctcccaaagtgctgggattacagtcgtgagccaccatgcctggccagaaattcataatattgatataattatatccactgattttggggggcttttattaaaccttggagtcttgtttggaaaataatttccttagacatcgactggatatagtggagtaatttgtataaaactaagcttctataacaaagaactataggctgggtgcagtggctcacgcctgtaatctcagcaccttgggaggctgaagcgggtggattgcctagctcaggagtttgagatcagcctgggcaccatggcaaaatcctgtctctaccaaaattacaaaaaattatctggacgtggtggtctgtgtctgtggtttcagctactcgggaggctgaggtgggaggatcgcaggatcgcttgagccctggaggtggaggttgcaatgagctgagatcatgccactacaccaacccggcctgggtgacagattgaggccccctctgaaaaaacaaacaaacaaaaaacagaagaagaactataaaaactgaatagcaaacaacagaacagctgtttcatggtattggaaagtaaacaagacaactaagacttgagggtccaaaaagtcagagagaagagtgcattgacataagcctgatattttccacagcattttactctcaggaaatttgctgtaacaagtataaaggtggaagagaaagcagtggcattgagatcgtggtactcactgggatgagtctacaggattggagttaatggctagtaagtcagcctgaacttgaagggctccatcccagaagaacagattgcatgaaatttcacctcaaggcattcaccaactcataaactgtaaaatacaagttcaatacatctttgtttctaggtgctcaaagcataaaaaattaatcagatttttgtcagtctcacagtgctgaggagaaaaaaagtggagatcagagcctggaaaaagggaggaaccctggtaaacttccaggtttccagttgagacccttgaagggatatacctttgaagagagggaaaactgcaaaacaacaacaataacaaaggtttaggaggggacacagtttttgtgcagcctctataagctggctgaaactggcttaaggtccgcagttgcttatgttgtttgtaaggcgtatcctctgtccattggagttgatatggtctgggttgtaaatcagctggtaacttccctggtagctcccattgttagggagtttggcaagagtatggatttcctagtagcctgaggaatttagaaatgcaccatgccagccaggccctgacctctacccctaggtatcctctgtgtccttaatgttagggtctgtcttagttgatataaagaggtgtctcagatcacagtgtgaatcccaatcccagctccaccacttccaagcagtgtatttaggcaaattacctttgtttcttgcctcattttcctgtctagggaatgtggggtggagaggatgatcataactaccatccgtaaactttttttttttttttgagacaacatcttgctctataacccaggctgaagtgcaatggcacgatcttggcttgctgcaacctctgcctcccaggttcaagtaactctcctgcctcagcctcccaagtagctgtgattacaggtgcccgccaccatgcctggccaactttttttttttttttttttgtatttttagtagaggtggggtttcaccatgttgcccaggctggtctggaactcctagtatcaagtgacccatccacctcggcctcccaaactgctgggattacaggcatgagccaccacgcccggccacatccatacacattaagtgtattgagactgtggtcactgctgtactttggcacatgttaaacacggaataagtagtatccagtatcgcaaaagatatgacctagtattcctaattcctgacctgattttcccttgcctatcattgtgttgcaagaagcttaaaatgcatgctgtctttagtctgccctcttattcttttattagaacattgctgaaaagctttggtttccttgtgtcttgttttcttccaggactccattttggattcattcattcattcattcaatcattcaatcatcctgatgactgaatgcattgaattgatgatgaaggcattgacaagcattgatttagtgcagatgtttgtccgtctcctgctctttcaagcctcatggccccctcctgctatcccaccatggcgctctctgttctcagtgagtctgtggggtctgtgtgtggtttttttgttcatttgtttgttttttcagacagagtttcgttctatcgcccaggctggagtggcgccatctcggctcactgcaacctctgccttccagtttcaagtgattctcctgcctcaggctcccgagtagctgtgactataggtgcctgccaccacgcccagctaatttttgtatttttagtagagacggggtttcaccatgttggccaggctggtctcgaactcctgacctcgtgatctgcccacctcagcctcccaaaatgctgggattacaggcatgagccaccgtgcccggccctgtgtacgtttttataatgctcctctcagttcttctttcccccgccccactctcagacacacattatggctataatgtcctttatgggaatctcttggaagccccattaactgacctttccctgatcttcctactgacttcactttattcatttgttgatttattacccaatgttttttgagcaccttctgtgttccaggtatgatttcagtcactggggatagagcaccaaataagcaaaaaaaagtctgtcgtcattgtatcacaactttctcactgtctttctgggcagggtaggcacagctatgtgtccctatctggaaatgatggctatggaatgaaatttccaccccagggaagaatgcagcccccatctgtatgatatttcctgattatctctgtgccaatctctctgatactcttgggaacttgcccattctttggtaaactctttctctttctacaagccccaacccagatgttgcgtaaaacgtcagtctttccctaaccctcccaagggacctccctgagtgctgcataaatatctgtgttgaataaatagtgacagagataaaaatgatgtggttctggaaaagggcagtcagattggtgaaagcacaggctgcatttcacttgggtgctgcgtgatggaacatagattgctttttttatttttccttaaacagaccaggtaggaagaaggtatggctacagccttcaaatatttaaagagttggcaggtgcagtggctcatgcctgtaatcccatcagtttgggaggctgaggtgggaggactgcttgagcccagtagtttgagatcagcctggcaacacagcgagaccctatctctacaaaaacattttaaaattagctggatgtaatggtacacacttgtagccctaacagcttaagaggctgaggtgggaggatcccttgagcctaggaatgtgaggcttcagtgagctatgattgcaccaccggactcccgtctggtccacagggaaagttttatacatatatacctgcatatatacacgtgaaattatacatctatatatatatatattagatgtatatacatatacatacatatttatatgtgtctgtatatgtaaatacatatatacatatttatatgtgtatctacatatatacacacatataaatacgtatggggtttttttttggtgttgttttgttttgagacaaagtttcactcttgttgcccaggctggagtgcaatggtacgatctcagctcactgcaacctctgtctcccgggttcaagcaattctcctgttcaagcagcctcccaaggagctgggtttacaggcatgcaccaccatgcccagctacttttgtatttttagtagagacagggtttcctacgtgtgatatatagattagaaagatagatatttaaagagctgcctaattgtattagtccattttcatgctgtggatacagacatacctgagactgggaagaaaaagaggtttaattggacttacagttccacatggctggggaggcctcagaatcatggctggagatgaaaggcacttcttatatggtggcagcaagagaaaatgagggagatacaaaagcagaaactcctgataaaaccatcagatctcatgagacttactcactaccacgagaacagtatgggggaaactgcctccatggttcaaattgtctccctccaggctctccgataacacatgggaattatgggagctacaattcaagatgagatttgggtggggacacagagccagaccatatgactaatggagtttggaagtggggatcaaattgaaaaaagctttcaggagagtagataacaggggttggggaagaataccttagaaacaagggcagttcagcagatgagacccaaatacccaccttccagcctttgctgcagccccataccagacaaatggaatcttcacgccctagagctcagtgtccatgttgacctcccccagaatttcccaggggcctagaagatggttccagtatcatcagtggcccttccagcttggtgtacagtgccagaggagtgaagcaaggctctacgctcatctttttttttttttttttttttgagactgagtctcgctcagtcgcccaggcgcctgccactacacccagctaattttttgtatttttagtagagatggggtttcaccttgttagccagcatggtctcaatctcctgacctcgtgatccacccgtctcagcctcccaaagtgctgggattgcaggcgtgagccaccgcgcccagtccactcatctatttttaagcagtagatttatgtagccatgccgaagaggccctgagaagctgtttattatgaaatcaaacttgtggtttctggaaacttttttctaactcagcaggtgatgccattagagttctgacat

SEQ ID NO: 575 - DNA, 5423 bp, Homo sapiens
tttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagtcaactaataatttaatgggggcagagacggcagcgaggggtagagctagcgagggagagagcgagagaagcagccccgtccggggactcgcgctcacactcacgcacacacacaaacacacacacacctctccctgtgccacccagcaacacccggcctcgtcacaacaacaacagccgcggccgccctctatcctgcccgggggcccagccgaaagccagggcgactctagaggacgctgcccgcccccctctttcatttcgggaaactcctgatcagttttgtcggggtttctgggtttcttttcccccaaagtcctagtgccattgtggtgctcgttgtttacctcggactctggacgagtgagagcttggcgactttttggggggagggggcggggagtttgtcgctgcctaggcggtggaggtggctgggggtgccttctgatcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 576 - DNA, 725 bp, Homo sapiens
ccttccttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaaaaaaaaaaaaaaaaaaaaaaaaaaaaaaaaaa

SEQ ID NO: 577 - DNA, 118870 bp, Homo sapiens
gatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgcagttgtggtctcagtcatctgtggctgcctcgctggtgtgggaaggtcagctggagtgctgagctggaagggaaggagtagacgccagctctcctcaccttggctctggagctactcttcttatacttggagctcttcttttgggaggttagtccaaaaggaatgacttggcagcttcactggtctttagccattcatgacttggcggacttcaccacatagactgcagtcagcgttctactgagagcaatgagaatgtttccccttgggagtgcgagtcacaaactgtgacatccctctgcagcaactcatccaaacagcttcactgaggttgaggttgccaagtggcttcctaatggttagtggtcttctgtgggagggtgactagctctaaccttggaaaaccttaaccacaagcacctctttctgtagcctctggtggcagtgagaggaaggtgctggcccagggtggggtgtctgatgctagttgcgtgagcctgagtagacgacgtgcttcagggattgacttcttgagaagtcctcagacgtctctagagtacgtaaatacattgactttgtgcttatcagaaataattttattagtatataaataagccaaaacagcaaaatgatgggagtttaaacatatattcattaattttttcctgtgaattggaggaaaaactttgtggtgggatatcctttggggagttcaagctgccattttgtattgctgccgtttgatcgacatgcagttttgagaattgatggttcggaggccctgtagtgactgagcaactgcctgctgttggtgatatgtccttgtgtcacagaatccatttgcccacttatgtctgcaggagctcagaatgcattacggtcccagatcgggaccttccaatgcctgttgcctctcctcagggaggcagaatggtgtagtgagttcctagagtatagcctctgcgacgtgccagctctgtgttcttgggccatgttatttaaccaggctgccaactctcatatatgaatgggtgtaatagttcttacttcatgaggttgttagtgcctgccacctaggacataatgactattagttcacagcaggccaaggcaataattgttaggtgaacttatagtagaaatctatacagctactgccagctacttcactcttgctccagaaaggagctgtcaggatgtaggccttgtgcccactgcgctgaggggtgatgcaggctgtgaagtcactttggaccctggcttttggtctcaggccacagacctgaccaaaggttgagtgtagtcctgagtttagactgaatatttggtcaggaaggcttattttgctcatggtccaaaggacaagggaaataatgtttcagaatataggaagaatggtactggcctggcaaggtgtcatttatttgctatccagcctgctgtaagactgtgttagagtgtgtgtgggtatgtgtgcatgctaaatagagctgcctgcatccatcaggggtcttgatggccaaagcatctgcctgccctgtctccctgagaggaggggacccaggctgtgttgccctcgtgtgggtgttgtttgaagccatagaagtggcaggatgtggaactttggagattgctccaaaattggacaacacccctatgcttcctcttgtctctggtcaatttgaaagcctagaatgaacatctctaccgtaagccatagacgaacgccctgtgagaacaacagttgtcagtgctgtgttacctgatatgggtgggtcttaacctttttttgggaactctccccccatggaatgcacatacaaagttttttggggtttttttgcagactctcactctcttcaggctggagtgcagtggcgtgatcatagctcactgtagcctcgaactcctgagctccagtggtccttccacctcatcctcccaagtagctcaggctacaggcacgtgccaccatgcccagctaatattaaaattttttgtagagactgttgcccagactagtcttgaactccaggcctcaagcgatcttcccgatcttcccgccagcacacctggcctcacaaagttttgcatactgtgtcaggatttaccagctccttaggcagctggggccctttgtttaagaaccactggctgagaataaacctaataaaatctgtgtttatacaaaagatcaattaagggaagataggattttgcagagattcttcttgcaaagaaatgtaactactaagcttccctagtgcattttaagttggaaaaatagcatatgcatgttttcctatttttcataaagggaggtttgcctgttttgtcattgaatacattttagttcactcttctgaggggacattcccatttgatgaagtcttttatccactgttaacaacagtggtgcggagcccccaaaggagccagactagaataagggagcacttttctgccctcaggcaatttctcctgggaatctcagtgctctggtggactgcagtatttcctgtggaaggaggtaagtgtttgcagggctggccagcaggccagcggggtccatgttctggagctgttgtcacaggttgtgggtttctaatagtcttaatagtttgaggagtctcagtggtgatcatttgaggcaggagaaggaatttccgtggtattaactgaggatttgctgcccctcagcaaaaggaaagcggcaagggaggtgtcaagggccatcgtcttctggctctcagtgagtctcagccccaaagtcatgcccttctccattttatgtatttggctactgcacagactttctatgagaaaaaggattcttatgttatttaaaaatcaaggttttaataactgccataaatgtgtatacatatatatgtatatatgtatgtgtgtatatatgtgtatatgtatgtgtatatatgtgtatatgtatgtgtatatatgtgtgtatgtgtgtatgtatgtatatatatgtgtatatatgtatgtatatatgtgtgtgtatatatacacacacacggaattttagcaaatgtatgcttttaacatgcctaaagttgtttttaaatccatgatcatgttggttcccagccatattcctaccatttttccttaaagcttaacctaaaccatatatataggatgaaaaaaaattagcacaaataagtatctttgggaaaagcagcccttttgtttccttcaaggtgggatccagggttttgcatagaatggaatgtgcagcactgaaggttcagaaccagggatcatgtttgctcagttttccaaactagcacttagggattgttatgggaatttggtttcagtcagttggccatgtgctagggtgagaggttgtggaaaagctacaagttttttgctggtcactgaatttcagcaaggcgtgtaccccgtgtgcctctgtgtctgcacgtggcgggtaagggaactgagatttaaaacagtgcatgagagttctgcctgtgctcagcaactgaagggcacctgggaaaggttcatttccttccctttctaacagatgaggtgctggaattacaggtttatttgttctagaaaatgtactgaggaccttctgtgtgccatactattggctaggaaaaggtggaatctactagtagaaagatgtttcggtgcccaactagatgaggaaggatgagaagtggcaggcggtgctgctgttgataggacacagtggaagcagagcattcggtttgttgttcagtgtttattaagtagattcagtcttatatatgatatacagattcaaaaggaaaaggattccacatacttatgaaatcagtgcatttagcaagtaataccatggagataacagctcgattaacagctcattggtcttttgttaagtgagggagagagggagtcggcctgtgctagtcattccacaaacaaaacagaatttagtcacatcacgtagagaagacacattctaagaattaaaatattaagccacatttactggtaaaactcactatatagaacacaaataatttttatagagagcattgaggaggaagtcctcacctgcttagaagagccacgttaagttgcataggtgcatatctgtaaaaatataatttagaggtgaagccattaatagagtcacctttaaaagttggtgccatccactgtttgccttaagtgcttactatctggagccctgtgcccctccccggaggtgggacctcatgaaggagctgcccccagaggaaccctgaagaaatggcttgtactatctgcactgaaagtcttaaatctcatctcagatatggaactcatgctcttccaaaacatgtctaaattatgccagaggactaaagacctcttgggttgtccctaaatcctggatggcttgatcctgaaggcaacatgagtcattctgaccttcccactcccaggctgcccagggaagaactacattcatcccacagctctgcagcaaagtcctgccttcccttttcctctgtccatgcagttacccaccagcagccaataagaggtctctcttctgactcctgctcctaaatggaccacataattgaggcatatgggccatctaccaggtggaaagtgtttttcagccaatctgagttctacgtggtataggttttttgttgtatttttaggtggaaacgtaggtaaaaagtgagaggtttttgtttgtggctttgctaagcagatgagcttagtgaggtgcatcttcctcctcaagagcaagtcttgcagaacacacagggactgggggcatctgtacatgtaaacagtacactttcactgagtccaaaattaggagcaaaaatacaaaggttcacattggtcttaggtagatacaggcgaaaaaggattgagctgtttagctcagaaacaacaaaaacaaagtttctaaagcaccactaaattatataaaaatcagaccatggacggattgaaactggtattctggtgaaatactttactattttgtaaaaagttttacaaaaaattacaaattaaaagtatcaaccctctgagttcaaagcagcattttgaaaatgaactggtagttaatcctgtaaccacccttagagttgtaagtggcccttgggaatagggatggatgggttccacctgtttgaaatcctcgaaaaccctcctaactccctgcctgtccccctccccgtcagcactgtccttgggaataaactgtcctttgtaagagtggtgacggtaaaatgaatttcagatgggttacacacactatcacttgtctacctgatgatccaccactaagaccaatgcccacttctctgatgctacccttcttgtgggattagcctcctgcaaagactctggaattggagtatcctactcttgcatttcctttttaacttaggatcccaaatgatcactttgtgccctgaggcccttcagaagatttttaaatggctgtgggacaagggctttgggagctccttttgggagaaggcagtccctctggtgagggtgagacagcagtgagcttagttcatcagaaccagctctttggtgccctccaagtcgggagtagggggaaggggttgaagctgcatcttttaaaacaaaagcaaaacaagttccctgactgagccagctaaatggaatcctgtttccatgcagaaacttgctcctgattctgccatctctagggcttcaggtgtagtttcactggaaaggaggagcccacccaagaggtggggtcgacatgatgaaatccattgtcctggaggggcctgggaggcccaatggactttaacaacatattctttcctttctcttgaaaacacattgaacctacgctcttgccgcagtactaaggcaggctggagggtggtcagttccaacagcttgaactcagaaaaacatgacttcaaactgtagcttatgctgatctttagatctaatccttgtgtgggtagggggagggagccccttccccagtctttctcactcctgtctgccaagaaatgcaaacggttcatgtctagcttgggtactgcctctgggaggagaagtgacacgttaagtaactgataccaggaattctagggtggcgattgtctctgccaggttttaacattaagattttcacaaataattgcctggggtaacatttttgcaaaagatcttactgattactttgtagtattgttcacacacaaaaataaatatttacacgaattcaaatgttgagtagtactgagcaggtggggccagatgtgtggatggctggggtgtgggagaggccttgggcactggaggttgtgctgtgctaagggtgagtctcaggtgtcctggccctgaccagaggcctggggattggtcagatggaaggcagaggtggtgtggctggatggggtattggaggccacttgagagataacgaccacccccaacctctaggggccggaagtaagcacggggtgggcaccctacctttcagagttctggacctgaggcaggatggggcatcctcactggtgccccccccatccctccttggggggagtctgccacagtgccgggaggcagtggccacagctgcaacaggcaattggctgcagaaaagctggtttgggaaggggtgcctgttctgggagcgagtggctctccgtggccatcctaggatccactcggccctggctcccctggggcctctctgctctgagggaggaaaggcaacagagggcttctgccagctctgggcaggggcgggcagcagagagctgctgtcatggctacggagtgttgcacggagaggccctgggggcctgctgaggtctgggcgagtccctggtttagcagcactggtaggtattgcactgagcaagaggaagtgcctatcaatcaatcaatcagggaggaaggaaaccaggccagctttttctttttgccctttttcacactccagggattatgggtttcttccaggaccggcccctccggaagggctggtcttaggagaacccaagtggctcctccacttccactgatccctttactccaaacatggcgcaaggggatgggagctgcagcccgccctggagctcacggctgcctgatagccggggctcaccctgaagaagtggcccctcttggcaggagtgagtctgaggggccaggcctgtgcacagaagttcagacctggctcctgggcagcggggtgtgagggcaagggccctgccaaccggctgccatctcccagcagtccgtcctgtcaagcagctgagggccagagctggagggctgcagtggctggttagggacaggacgctctctgggttccagctcctggacacccagtctggacttacttacctcccaggcagacacattgtgtgggggagttggggttacagctgttcagaacaggctcagggcacatcctggaaaaagcccacgctggagtgtgaggtagaatacaggtgaccatggactggggcttctgtagaatggggtcggggtgcctcttttgttttgctttgccatgggtgtgggtgaggtcctcctgcttggcgttgcctagggaggtgcctggtggtgtccctgtggcagcactgggatctgcaacaggatggcctggccaagggctagcggccacagggtgcaccaggcatgcagaggaacagccagcctggcacctgtcctgcccctactggccccagcccacatcagtgtagtgatatggaatgttaggtatggggatacatccttctgatcagacagacacagactagcaatctgtacaaacacaaaagaatccattttcagaaaaataaattactaaggggagaggaagaaagggtccactttgcttttctcaataaatatgcaattctgctcacctaagacttgaaaggtaattatctgggggtgggattctaacatcagggtccacgaaggtgattctaaacagagctgcagccccagcgccttgtcaggggagcccccaacccttccagagctgccccgttggcctcttccaagcaggtcagagcacccgtgtggtgagattccaaaaaaaaaaaaaaaaaaaaaaaaaagtgtccttgtgcccaaagtctcaggtgcttggagtgtggctagaaacagctcttttggatcccacctctttcaaaaacaaaatgtaccaactggtgaggcaggaagccaggtccaggctgggacagcctccttccctagggcagtgcgctccaggtgccggtggggtcagttctgctgtaggatgaggttttccagttcatctgcagagcgcagcaggaaggcagcagactcccggtagcccgcgatgagctgccgcacggcgctgatctccgtggggctgagctgagcggtgggcacgggcctgctggtgctggtgctggagggggtgggcgtgggggtggtggaggtggtagaggccccgcctttcatgctgaggtccgtgggccctgtggagagggaagtagggtgagaagggagcagccaccctgcctggcatctgggaggtgtaccttccttggcactgtcataacctatggcctagtgcccactgtgagttgggcactgaagtccgtggctctggtccatctccctgatggctctatccctagtgcttagaatgggcctgcgggcgacagggttctcagagaatcctcagggtgatcttgcaaggatccggttttaggtgaggaagaggcggccttggggcaaaggaactcctaagatctgcctctcctcagtgtggtgagcagagcttgggaatgggaaatactacttccattgaggaactgtgggacaagtgctaaaagaaagcctctgccagtgtgcctaaaggagcagcacccatctgtgtgctcttccccagcccagacaccgaggctggaaggggagatggtgtgcaggagactctgcaggtaggcaggggcccaacacacctgagagatgcgtgtggggaaagcccaggaggagctgagagtcgagccacaaaaggccaggagaagaaacatctgtgtgcccagacaagaaaggggcttctgtccagctggagagaggccagctgccctggttgtctggggggagaggtacaggccagactggccaggccataactgcacccccaggagggaccatggcagccagtggatggaggaaggggctgggtgtgtgaagcctctttctgctaagcctcaagcacctcgaatcccccctcctgggaggagtcctgtgcctgagtgaggtggagggttcatgctgctaggatacgagggagtgtgggccggaaccatcaggacaagactcagactcgcttctggagaaactgcccgccctttgtcctcggatgatggcaaagagggagcctgccatctttcaaaacacactaggggtgtgcgtgttggggaggggaccgccaggccctgtcctctcttggcctttcccaagaagctcctggctttggagtcaggcaagtgtggattcaagtcctgctctgctacttcattggcaaattctttaacttctctgggcctcagagccctcatctgccaaaactaggcggctcctgcgagcagaagctgagatgccggctgtgaaacactcagcacaggctgaggctccttctcagcccacaggaggcctgactgcctagactggcccaatagggaagggcttccaaagaggtttcagggctttctgaatgggctcccaggagacctggaagctcctggaatttgaaaagcattctacaaggtgttcggcaagaaacagccaaagaagagagaatctgggcaggtgcaggcagagctgccgcttccctgggaagccttctctgatgcagccaggtcagcttctctgttgtctgccctccccctggagtcccttccccacagctttatcttccacgggggtgtgaggctcccccagctaccctgaaagttctgatggtcacattctctcatgattgcatctccatggcagtttttatgctgctatgaagagagatggacaagctcttgtcacgggaggtatccagactggaagtaacatcttgggataaactatggaaacctgactgctgctaaaaggaagctggtgcagcccccaaatggggaaggaagctggagtctaagatgggacagtttgtcacatggggttatttcctctccggccagagaatgtggacaccaaggaggaggtcctaggaactattttctaaatagcgtccttggaattgagagttaaggaaacagttgagtctgttaaaatcaaacacagggggaaggggttggggctgtgtctggaaacagcagccaaacaggtgactgactcccagggtgttgtcacaatgcgggactgagaagcttggaacaggagtgcctctgctaacttctggatattgcaggggatggacccagagggatgcgggggaagagggtctggttctctctagggtggttctggtcccctctgcgtcatgcttgggagtggccagagcctcctggcatagtcaacatgagcagtggtcccggttcctttcttttctcctctccccaagtgctatcctgttcatgcctgtgctcagagcttcctcccttctctcctgggctgtagctgaggcttggaaaggagaaggtccctgtttcctgcagctgatctgatctggagacacccccgtgtagactctggttacagccagatgctcaggttgccgagggactgccgtatggtgggtagagggataggagtgagcatgagttacccagcaccccaggcaagacaggccgagcctgattctatctaagctgatttgcatctccagatgacaacataatgagcaaagtgaggagctctgagccattaatacggctgcccggctgaggtaccaaactgattgaacaatacttgaaaggctgaggctggggaggccagtggggctgggtggccctgcaaccacgtggctgcctgttgtcttccttcaactgctggaggatttaaacaatgttcttcaaatgaggtactagtgctcaaggacaggggctgccccaggcaaggaggtaaatgaccagatttctgcgtcagtggcctccccacccaccatgaaggaaccagggtattcacagatgggagactgagaccccaggatgcacaagggcagagccagctgcctccctggaagaatcattctctggctgctgtttgtgcctcttgggcaggtgtgaacgggcaggcatgaagcaggctcagccctaatatgagaggcccttaggagggtcagggggacttggcagccgcagccctgaaataggtcatgctgggtggacaccaggtagaggcttgtcaccatcgcctgctgctaggagggagcaggccccagaccaccctcacctcacctgctgagccccagacccccatgtgtagggggggcagggcttttcttcctggaatgaaaggagcccgcctaggacagccactccacctctcaccgtgctggccactccggccttagcttcagggattagggccaggcggcctcttattttaggttaagaggcattaggaagggatgaggagttaagcccaggcaggaatcttccagggacctgcatacacttcctggttctggggggtggcgggggtcaaggcgagtggaggcagcctgggcttcctgccatgggtggggactagctccctcccttgctgcccaggaacagtgaggggtctcctgcagccaaggatgggggcttagggaatcctcaggcatgtttagccaagaccttgcaccagggttccccagcttacaggtggcacctttctccaacctactcaggttcctcaattcttcccttcattccctggcttctgaacgacccccaaagcacatggcttctgcctcttgctctgcccattcaaaccttcttacaggggcagacagaatgacacagaccacacaattcacggcccttctgtgcttaaaacctagcaggggctcctcctgcacacagaacacaacccgagtgcctggcccaagaggtcctgtgacccaccaggctgaccccactcctcccctgcttcccttggcctcacagtaaaggggtctgaggttccccattccagttcgtgctcacggcagcacctgactccatgaggaagcctctgtctcttcgggggctgtctcctctaatggtctgtgccccatctgcgcagagtagcctggggagttaccggaaaagcacctactgaatcacccagctacaggagcggagcgagggagcaggtgtgcaccatcaccccaggtgtctcagatgtaggctccatgaatgcaggggcaagaacggaggcccagcacccaggtgaggaaagctttcacctcacaaggcaggccctgagctgaggcctggggagggagccgccctgcaggccagcggggccacagctgggccaggccagcagctgtctcactgagcctcagtcgctatgggtgagacagacggggctgcggagattcaactcaggccaagaacaggcccttggctgggactcggcacccacagggaccctgggggagtggaaccagtgagaggcgccggtagtgaaggtgggaagtgttggagcaagcgtcactggcggtgagaagggggcggtaggtttttgctttaaccaactgagtctccttcaccttccaatctaaggaccagctaagacgatgaagtggaagggtgccagagccgcccctcctgctccctatgctgtgaggcagcccctttccatcactggcctctgcttccctctccccattccgctgcccagggctgctctgcagacccagctgggtgctggtcgggaagccagagcccaggcctcccccgactcaccattactgtggtttcctgtttggagggaggcagggggctgcaggttgctgctcaaggccccgtacccgcggtaactgtagttgaggccgccgttggcgtacacagggtcctgggagtaggaggaggctggcagtgagtaggtggagtgggtgatggctgcggagtcccgcgagtgctgcttgtccagggctatgggctcatcctgcagaggggagaggggggcgctggggaaaccaaggggcagctggccccaactaccatccctggacacaaggtggataaatgctgcggccccaggactcctgggacccaatgctgcggtttgacctgtgggattctgtctgtcccctcccccagccaccttccccccgggggctttccccaactctgctcatctccctgtcagcgtatttgatcagggccctctggtctccagatgaagtccaggcttccgtatgaggtctgaggagctctgagaacaacacacctgacctccacccacctcctctccttgtctttgccctcctgttccccctctgcccttctcccgactgtacccatcacagctccctcagtccacacccatataaggcctgccctccctggctgcccaggagcggcccctgtagtggctgcggtggcaggtacctgtgaggactggtagatctctagacgcatccgcttggctgcctttcttgtctcgctctcacaggcagctgccaggatgttttctgccatggccgaggtcagatggggtggcgtgggtctggtctgcaggcagaacggggatggagctagcatggggcccgtgggggccctgggcttgtgcagagaccctgccccaggggtgggtggcacagggtggggtttgggctccagcgcctcagtctatggagctgtgtgatctttctgggccttagttccctcatttgcaaaccagggattatggtacttgcttccagggctcctgggaagaccctgggtgaaggggcccgggcatcctgggagtgtggcaggaggtcagtagtggcaccgagggaaagtgtgggccaggcaggggggactcaccatctccatgccgttcttcttcatgcgacggcaggacttgaggtacgtgcggatgcgcttgcgggcccgctcctggaactcagggaactgccggctgcaggactcgatgatggcctggatcttctccttgggctgcttggagatgggcaccatgcggtccaggttctcgtccacaaagagacgcacaaacatctgtggagacacgggccatgggaagggctggccctggccttgcccccatcccaccccacctgtttccggccggtgctcacgttgaaggccttaagacgctcagggtccatgccttcagagtcgttcatcttgtcattgtcctcatggtcatcgtggtcatcgtcgtcatcatctgccgtcggggcccggcccactgtcaggtcctcagggcagccgctgacctcggtcttgatggaatcgtagctcccagagctgtaggggggggactaaaaggagggcaagaggcagagggttgggccaagcagctgctcaagcccttgctgggtctcctacaggcggtgagcttggggaccagggtggcacgcatgccctgctgccacgagagccatagctgcgaggccctgagcaagtcactcccctcttctgctcccttcatctgtgcaatggggacagcaatgctaccacctccctccctgggctgccgcagggaggaccgactgcaatagtgtatgcagagacctggttcccggggctgctgagcgcttaggagggtgtcagctgtttcctcagcagaggccaacaccaggacctgccacgtgtacaggggaaaggcagacatggaaaggactcccaccacccgccagcctcctctcgtgccaagatatattttggcttcggggttttcctccctgatccccaaggggctgcaaccccaagttgacaaccgagctgtcaccaaagcaacgagcatgctgtctgtcgggaggaggaacagatgcgctgggcgaggtagccagccagggcgacaggtccgttcagcaggatgcgttcccgcagctcctgagctggacttctcctgtctgccccccacccaggacagcacagtggccccttgagaatatgcgggtagaaagggagagggaaccggatccggcctcccccagcagtctcctgtcctccagtagagaagggctccagccctctgctcccaccacgagtttctccctggccaagcccctcaaccatctctccttaggagcagctccctcttttcccccatgcccctccatcttctcatccttcatggctcagctcccacaccacctgtctcctgcccctgcctcggggcaccgctctgggacggctgaggaccactgttgcctttcggaaagtttgtgccttcgatgtgtcctaagtactcgttcagatcgtgactgacagtagcctggggacactgtccctgccctcaaggaggttggcatctagcaggtaaggcaggctcagggaacaggtggcggtatggtcagaccctgtgatgtggcagcatggccatggcacagcccggaagggaacagcactcactgaggagcaaatccaggaagaagggcattgcctggcacctggtcccacagcacggcccccgccaggcctctctccctgggaccaggcccgcaggggttggtgccctagggtcactggcctggtgcctgtctcttcgtccacatacagacttggataggggcaggatgccgagggcccccgctggctaccataactggccgtgtggccccaggcaagccacattcccacgccactcctcagccaaaccctgagccagggccagggcagacagatggagaaaaaactaagataggagctgctggtggcgttcctgctctcatctcacttccctgggccccccatgtaccctgtggccacagtggcaatggctgctgaacacaactcacccccttcatggaacagcagctatgcctgtcccttggacccaggcaaagcctgctctggccagaacctgctcccagccacctgtgctagacacatagcaacaactcagcactgagcccatggtacagaatgtccccacgagacattccaaatgaggcaggcagtagcacctactccactctctctgcagaagagaaaacaggcccagagagggagaagagcctgtccagaggtgtaagctccaggaaggcacctctggcccccgggcccaggttggagaagaggcactactacaggaaaccttagtggcccggaggcagcttgtggaagtgtgggggaggccccaggaagcaggggggatgcccactggtaggggtacgtactgtgcccacccttaccaccgtccatcagcctagtcaaaggaggagttccactgcccacatccctgggccctcgcccttttttcgcacgacctataaaatggggacaggcacgcagacaaaccaggcagtgggaggcctcgtacctggctgtgccgaaagtggccacttgctgttatccccagcagatgctgttctgggggagggggatgggttgtggggatgcatatccacctaccacctctaccaaggcaggggccgtcagctccacttcacaggctcggagaagggggcctggcttgggggcacactccaagccatctcccattccagagcttcaccaggaaccgaacacataccagccacagccaccaccctggctcggtgtcacacacatgggctggctccagctaagctctgggcgtatacaatttcattctcgcctcgcgacagccctttacagaaagaaatggactcagcccccagccccacacacctcgggggtggtcttcaccccgtatttgacgcggctccgcagcccgtcggcaccgcagccatccgaggggtaggaggctgtgccaagtgccgtggccggcgggagcttgtcacacaggttgatgggctgatcctcggcggccgtggtgaagtccatgggggccacggcgccgttgccattcatctcggggaaggcagggtcgccctgcgtgctgctcgacgtggatgggttcagggtggaggagccattgccgctgccactctcagaggaggagtcatctggaatgagaggcctgggtgtgaggccccacccaaggcactgtggccactgcagccacctcggagtatcccaccctgtgtcctcctcatgagtgtccctgggttggggtgagtgctgctaccccacctcagaggcaatttgccccagcccacagcctcagctgaggcagccacagggtcccctctgccagaacagaggggccatcaggaggggtgtggccaggcagggctgtgcagggcatggagggtcttcctgcaccccaaactcgcaagcgttatgtccaggcttaagggagaccgagctccaagggtttgggagtgagtggcctgtcagagggccctggaggccctcgaagcccggccaggctctcccttctccccagctcccaggaccgcacctcccacccaccctgctcctgctgccgggcactgccttgcagcttcgagctctcagagcccctgcccacggtgggccctcaaatgtctccttcctctgccggaagcaggaaggatggctctactgtgacctccagccattcactccctcctgtaagcaagcccagccctggcagcctaggcacaggcacggtggcccccgaatctgcgctccgtgcaggccccacggcctgggacgtgcaaagccggggctgcaaggtctggggtctgcacgcggcccccgagtgggcctgcccggcgtctcagggtgggcagccccggcaaagcactgcgagggcgccccctgccgcaaagagcgcggcaccgccagcctgcgggcgcgggggaggaaactttaaccaggggaccagacagttccagatacattccaggcctctctgcccacccagccccagccccagccccggcctcctgcttgctcagctgagacggcagaggctgaagctgcacgggaactcccggggtcactgtcaggtgagcacccgcgagggtcccggggaggtacgggtgaccctggcggctccacacctgcacccagagtgggtgggggaggggtggtcacagcgggccctgccgccccttcccccaggccagggtcacgccggaccccacccccaccctcccagccggcagattatgaagatttagtccccggtgctgggcactgggcacgcgcacctccagagcgtccccatggcgaccgagcggctctagcgccccaaccaattgctggcctcccggctgcccgggggcgggtccaggctgcccatcatgcagccaggccgggcagagggggatgggaggccacggcggcgcagtgcacccctccccctcggctgcagcaggtcccctgggccaggcgtcctgtcctccttcgggcagcctagctccaccactccctccatcctcccgcagggcagctccgggctctgctcaaagcccgcccatagctgcccctcactggctgcatcctcggagtcccggcccgcgctggctgtccccgggaccccacagcctactcgcgcccagtctggagccaacacattccccagcatttttactgagcacctactgagtgctggcctggaaacaaagtaatgactgcaaccaaggtgccagacctcctgggggacagatgtgccttactcagcctcgtgggtaacagggaaggtgaattgtgagaatgggggtgcccactttcctccacccgggaaccagaccagctcctcatgcagctcccactggctgctctccagcgcccaggccacccacatcccacctgtgagagccaggcctaatcctcactcccctgtcccatgctttcctgtagctgagtaagagtccggcccacagccactggcactctcagtcctgtgacctctgcagtcccccagcccagcctcactatcctgtgctggagctctgcaatctgcctgccatgacacctccagctgagcagatggcagccagccttcaaggtctggttccacactgccacttcaggctggcacttttctccactgtccctaggaaggaggcactcacgcctccaaccccagcttgctgcccggccctgccagggatcctcatgctcccttcccctggcccagggtcatcgtgagggccatctgccccaccaggacagaccctgtcaccagagaagcccctgcacctgaggtccaggagcctccacgggggacagggatgacacccatactggctggttacccacgctcccatgagctgcagggggcccatccttcacccaccttgcaggtgcgacttcacataccgacaccaccctcacaggccacttgcttgaccttggagggccttagattcctcctctggaatgaggggctgctcctcagtgggcatcgtgcctggcacacagtgagcaagtggtcactgccttcatcacaggcaccaggcccaaggctggctgcagtgccacaccctacataggcccagaagtgacatcccatcatcccaccacccacctcccaatcaggttttcccgagaagatggacttgccctccgccactgtgagctccagagacacgctgctcagggtgctcctggagcctctaccaggtcagatgcccggcacgggggcccagactctccagctaccaagacctttgcctcggggctgtgcccccggctgcctggctggggatcgacaggcactagtgccggggcagaacctcccctaactgcactcagatgccaccctggtctggccagggaagtggttgggcgggtaagacccgtaaggcaccaggtgctaggacctcgtatggccaagtgttccaagctgttagaagaaactggaaatctgcaccattatgtaaacagattttaaaatattggcgactcagttacatggtttactttttttttttttttttagggtcttgctctgttgcccaggctagagtacagcggtgccattagggctcactgcaactgctgcctcctgggctgaagcgatctccccagcagcgcacaccacgacgcttggctaattttttttttttttttttttgagatggagtttcactcttcctgcccaggctggagtgcaatggggcgatcttggcttactgcaacctccacctcccaggttcaagcgattctcctgcctcagcctcccaagttgctgggattacaggcgcccgccaccatattcagctaattttgtgtatttttagtggagacacggtttcactatgttggccaggctggtctcgaattcatgacctcaggcgatccgcccgcctcagcctcccaaagtgctgggattacaggcatgggccaccgtgcccagcctcggctaatttttaaagttttctttttttgtagagaacaggtctcgctatattgcccaggctggtctcaaactcccaaggctcaaaccatcctcccactttggcctctcaaagtgctgggatgacagacgtgagccactgcgcccaacccattatttatatttttaaaaacttcgacaagtaaatgggtacacaaatgtggtctattcatacgatggaatagtatccagccatgaaaatgaatgaagtttggataagcgctgcaatgtggatgataaaaacacgaggctgtgggaaacaggccagacggacaaggatactcagtgattccacttctacgcagcatctggaacaggcaaattcacagagacagaaggtacagtgaggctccacgggctgggaatgggcagttagtacttaaagggtgcagagtttctgttgggggatgaacaagctgtggaaataacagtgcttctggagtgtacacttaaaaatggcaaattttatgtcacacattttaccacacacacagaacccagaccaaaaacagcccctttgccctagtttataggctctatctgccattatctcattttctcatgccgcacacacagagcctactcagagggacaacatggatcgcgaaagcctgccttccccagtgacaccaaggtctcgcctacccccagctccgctcaggcagccccggcatgccagcccccaccccacacagctgcccccgcgccacatgctctgggggctgcctgcaacctgaggcccatgttttgccgactggggaggccacaggtttgagccgcggagtggctggaagaggctactccaccttctggagcctccgtttcctttcagagtgggtcccacagccgtaaaacacggttctaaggtgaggatggtgcccgagatggggcaggagctcaaaaggaaaccccaattccctgcaccccacattttctcacatcataactcacccactgccgacgcacgaggctcccagactgcaacgggggcttctggggatcccggagcccagcctgtgacagtctgaggtgggcccagtgagagggccactgtggggatgggggcaactgccaccctcggagctcatgctccagcagcgacaaatcaaacctgagggctccagaggagacggggctctgaaggggtgtcaccagctttctggcccctgagccatggtgtctcccctactctcggcgactcctgctcgcccttctgtgctaacccgagcaccaccacctcagggaagccctccctacctgccccgatctccatcgtggcaccggctgtgggccacggctctgcagaagccatcccagggacggtggggcgagggctgaagcctcatgaaccaacaggggcagaggtgctgctcggggtggggttggtccagcctgtccctcggccccacaagcagtggatttgatgccggctgcagccgcaagggctgagtttactccaactggaagccaggtccctcctttgggcccaccaggcccttccagcgagcccctatggctcacccacccgccccagctgtgacccagccttggtacttgctgttccctcttcctgctccactctgtcccgggtgtccccttggcgcagtccctcacttccagggctctgcgtaaaggtcaccttctcggtaagcccagctcccaccctgctctggcacactgacccctctacctttcttttctttttttttttttttttttgagacggagtcttgctctgttgctcaggatggagtacggtggcgtgatctcggctcactgcaagctccgcctcccgggttcatgccattctcctgcctcggcttcccgagtagctgggactacaggcgcccaccaccacgcctggctaattttttatgtttttagtagacatggggtttcaccgtgttagccaggatggtctcgatctcctgacctcgtgatccacccacctcagcctcccaaagtgctgggattataggtgtgagccactgcgcccagccccctctaacacagtagtattgcaaggagaggataagtgcttggaagaaattacctatttcttccaagcacttatcctctccttgcaatactactgtgtttattgtgtctctggcctgtgcccagccttcacagaagcggccccagccctagagacccagagttggtgcagctgtattgggtgggcctggatggctcctgctgccccctagatcacacccctccctctggtgggggcaactgagtcttcctgggctcgccggggtgagtgcatgccccaggcctggccagtcaacccatcacagcaactggtaatagcgtgtgaccaagctgggcccgaggacatcacgcggggactcctgctgcgatggctgggaaggtgctctctacctggggttgctgggcccgtggtgcagggaggcccacgctggggaaagcagggctgatagggggcacagatgatcccctgaaatccatctgtgcctgccacctaggaaggccctagaggttttggtgagggagctaataatttccttattggttaggccggctagaggcaggctcacaccaatggcttggtctctgagtagtccagggtcttctccctggcagaggccaagggatgggacccgggggctgggatcgctctgcatggggacctcaccatgacgcccagctcagtcctgaggaggctggtacccacaggagggggtggtgcccacaggagggctcatgcccacagaaggggctggctgcaaccctcacacccacccctcactgcacctggccaggagaacgcgcctgtcactgtttggggaaagaaggaaaagagagactgggggcagttgggttttgatccgattggaattcttcctcccacaacccttaaaaaaaaaatggatttaggccaggcgcagtggctcacgcctgtaatcccagcactttgggaggtagaggcaggcagatcatgaggtcaagagatcgagatcatcctggccaacatggtgaaaccccatcactactaaacatacaaaaattagctgggcgtggtggtgcacgcctgtagtcccagctactcaggaggctgaggcaggagaatcgcttgaacccgggaggtggaggttgcagtgagacaagatcgcgccattggacttcagcctggcgacaaagcgagactctgtcttaaaaaaaaaaaaaaaaaaaactgatttaaaagagacatcgacaggcgcacaaacccttgctgtgatggaatgcagtggggcccgggcagggatggtgctggtgtagggtcctgcagtctgggcgaccttgggcactgccacctcctgggcctcctcttatctacagtcctgggagttgccgctgacgccctcctgggctctggcactttatgactctgtgaagaaacccagctggctccatgggcaccgaagccccagcacacaggcctcacggggtgcaggcctccagctgggaggctcagtgggaagctgggagttctggatggaccctccacacctggagctggaagtggaacctaagggtgcccaggtgacctcttgtccccacctggtccccatcttgctgcttccatgaggcccctccaggagggtcacccttgaggccaacctgctggggcccagtgtgatgaaagcagggtgggcctgcccccagcccatggctgcgtgggcagcagagacatgtcctgaggggccttggggaagcagcccgggatgcaccccctctcagcatttccacaaaaccaggccctccccactgtggcaaagggcgactccttcatctgggcaggacccggagcccaccacctgtgcccagaatgcctacgggcagggaaggactgccgtgtccgtctatttgaacatggggcaatgtgctgctattcaaatggaggaattagtgatgaatgggggaaattgttcctccctctgtcccgtctccagaaggagacaaaaaccccttttacctcagcaaacaatgcccttatgtgggcgccagtgccccgcagcccgcacaagcccagctctgtgcgaaccaccaatcgccacaccgcgctctggggcccacagccagtggcaccctctcccggtgggcgactcccaccagctcccaggctaggctcggagaacgggaaggcccaccatccctgggaccacaggccaggtacacggccactggaggccagcaggccctgcgtgcagactgccttccgtgtccagaggtgtggctgctggaggcagtgccgcctccatgagactctgtcacagcagcagccaggcgggggatgggaggggcatcaataattcacacacaacagggcgacgggggaggagggggtgggagactgctggagccacggcccaccatggccagggaggcgtggacagtagggctatgggctgtggtctgggggtgctgaccctgctctgaatttgaggcgtgcacctccccaggactggccccctgcctgctttgacaaaggccagcgcccaggctgtgtttacacgatgcgtagttccaaggagcaccaggctcagggcaggctgcccagctcttcctccagaaaggcaggaggggtgcaggggtcaaatgggggacactaggaccctaccatccgggtgatggggccacacggggcacctgcattctccacgtggccctcaggccccagctgcctgcacagctgccctcctgagcgcccagctctgtccctgtggttcacacagcctggcccggccccagccacggagcagggagcccatgccccccatctgggtgccacacttgccccctgatttgcagccccggggcgccagttcctctacccccacagcatgcgcctcctctgcgtgtgcccctcagtgcccgggcagtgggcgttcctgctgaaactctggtcactctttgcttaggcaggtgccaatttaggccctcacagtcgggagcagcactgtccgacagaaacagagtgggagccgcatgagggatttgagtgccctagtacccacattttaaaaagtaataaagaaacaggtgaaatcaattttaataatctactttatttaacccaatatatccaaaatagtaccatttcaacaaataattgataccgtgttatcagagctgagatatttcaccttcttctttcctacggagccgctgagacgcagcgtgtattgcacacctgtctgcactagccttttccaaggctcagtagccgtccttggctaatgaattagacgtcacacacctagatcttcccctaaaactgaaatcatttctctctgcagagaccctggggttcctggcccgtagagaggtgtccaagctgcagatgatgttcaggccttgggacaggtggctcaagcggtggggccctggagacagacaccaccttcagtggagggggaggtggacaccaattatgcgtcaggtcccgagtgtcaggcggcgggtaactcatcatgcctgatttgcacaaccaccctctgcagcagacatcagggaggaaccagaggctccagggggaagtcaccgacccatcacccgggatgagtggaggcgcccagacaggccccaaagcaccacccaggccgcccagtgctctcagacattctgggagcctccaaggccagccttgatttgcccatctgtactgtgggacaattccctacccctgctaccagactgctccacttcctagagcccctcccccaacacctactggccactgatgccccggggaagcgctcccaggatgaactgcctgtgtgtgggtgttctccctggccccgtcctccaggccaagcacaggcggtgagaaataaacactaattcagtgtgcaaagatcgagccgagacacacagcctgctccccgtgttctcagagcaaacagagccactccaggccaccatgtgtgaatgattcacggggcagggccctggccccaaagcccctgcaggccctcctccagccctcccggaagccagtctgggttcggtgcattgcagtccttaggtcggagtgatgacgccaacgcggcctggtcacttcctggttcctgggaaagtcacccttgaacaggctcccggtggaggtgcctcaggagggcctgtccctgacacaggagcctgcaggatggagctctgtatgtgtcctgggctgaggggtggtggcgaagggcaagggcactgatccccacgtggccccactgggccaggctcaccttcacctccattctttttttttttttttttttgagatggagtcactctgtagcccagtggtgtgatcttggctcactgcaacctccacctcctgggttcaagcgattctcctgccttagcttcctgagtagctgggattacaggtgcccatcaccacgcccagctaatttttgtatttttagtagaagtggggttttgccatgttggccaggctggtctcaaactcctgacctcaagtgatctgcctgccttagcctcccaaagtgctgggattatgggcatgagccaccacgcctggttcacccactttctcagtaggtgaacctctcggctcctcaggccccagagcttgtcctccccagcatcccagacaaggccagggctgtgtaggccctgcccactcctggataaagggatctctcggtgctgtctcccagcgtctctcaccccttggcgggccggggcccagcacagcccagcattgtctgtgccgcctgcggcccagctgatgatggacactttcctgtgacccgggactgccagtgtggcccacagccaatccctggaaggcttgggccccagctctctgctcctgggggaggggaggccaggaggccgccgcctgctcatctgttgtgggtatttggagccttgaggaggaacaaacagctcttgctcctggggtgggggtgggtgggacctgcacccagagaatggggcccagctctggtttctggcctcagctgtgagaattagggtcagggcaatggacacagccataatgagcaggtgttggggagaaggcttggcttaaaagcccactgcaagagaagcctttcacaggccagcccagggaggctggtgcaggggccacacctcctgccatgcaatactgaccagagcagacgtctggccatgagtgttgggtccacggggaggcagcagcaggccggagttctgtgcctcctggtgggagagggctgctgtgacccagggatgggcccaggggagggtgggcatcacctgaggaggacactagaaagagccgcggcacaggggtaatgcgggtaatggtctctgagcccgggtggcctggtcgttactcccaccagctccttccccatcagccttatggcttcctgcctgatccctcacttgaacggcttcacgctgtgctggggacaccccatggcaccctgagtaccagaagccagaagcacacttctgcctggcaccttctccttggatggcagcactgactcctcgctgcctgcttagctgcccatcagtgtgggcacctggatgggtctggcatttgccagattgagaagcagggtcttgggaacttggggtccctggacagggcctggcacatgtgggtggggagggagggacagggactcaggacaagctgtgagtgcctgggtctggttgacaccaaggaccccctagcccggctccctttacgaagaagcacaacccgggcggtggttgggagctgagagcaggggtggggatgccgctgagggtggctgtgaggtaagctgcagtcagggtcccacaggcctccatggcagaggggaccaagggagaccaggctggctgaggaggcaagactggaccaacggggtggtgcgcagggctcagagaatctgggggaggtgaggaagaccgcccacatccagtcccagcctggcccccaatgggcctgtgctgtccacatctggtcctcaaccgcctggcaaggtgggccaagatgatcacccccagcccagcaaggggttggcacccgcccaaggctgcctggcaaggagggaactgagcaagatctgagctctgtgtgcccccacacttccctgcagacctcttggaggccagggaggaggcacacaggggagggggccgggccaaggagaagaggccaacagcactgctgctgtaaataccgagccctgggcactcaggaaacacacctgctccccagagacccgccctgctgcccagtttgcatttctgggggtggagggccccacccaagggcagcaggggccaggaggtaggaagccttggtcttctcactaagagctcctgggggcatgccaggatgaggggccacagcccccaggccatgtcacagagagaagctgtggcccagagttgggggatcggctagctcaagaccatacttcggggaagggccggccagatccatggcacagcacccaggacctgcctacaggatgccacatattgggcccgaccactccatcctcccagaacccttccatgccagaccctccccagatggcctggctgtggcctctctgcccttctctcctggttggagcttggggtcatagggagcttttggaaacaggtgacccaagaaaccctcaatcctggcatcgggcacctcctcccttcccagccccctgctgccacgcctctgcccagcttcccaggccacctcctcccaggccctttctctgattccccatctctgccaagagtgactcagtggccgttggttgagcacctattcagtgctagggcctggggataaagcccaggacaggagactcaggccacatggggccagccctgaggggcaccctgcagcgccacttccagcaatgaaaaacagggacttggccaagcacggtggctcacgcctgtaatccctgcattttgggaggccgaggcgggcagatcatgaggtcaggagtttcagaccagcctgaccaacatggtgaaacactgtctctactaaaaatacaaaaattagccaggcgtggtggtgcacgcctgtaatcccagctactcgggaggctgaggcaggacaattgcttgaacctggaaggcggaggttgcagtgagccgagattacaccattttgcactccagcctgggcaacagagcgggactccatctcaaaaaaaaaaaaaaaaaaaagaaagaaagaaagaaagaaaaacagggacttgagtgtccttccacaggagtggccaaaacgctggctctggagagacccagtccctgtggtctgggcaagttacttcccctcggagacgatgtttcctgccctgtggaacagcgacatgtatagctctgggctcacagggtcaggctgggcacacagcagggtcaggctgggcacacagcgggctcaggaatgggaccccagtcactggactgactagacaagctttgaactgtggctggcccacatcagtgtcagggaggccaatgactatgtgagaaaaaaggcgccaatactgcctcattgaaaagaaaatgaggctctggttacttagatacatagaaaagtctgagaaaaatagggccccagacatcattatttttcattttcttttttcctcctttatttttctatttttttttcttttttttcttttttttagatggagttttgctcttgttactcaggctggagtgcaaatggtgtggtctcggcttactgtaacctccgcctcccgggttcaagcaattctcctgcctcagcctccggagtagctgggattacaggcatgtgccaccacacccagctaattttgtatttttagtagagacagggtttttctatgttggtcaggctggtctcaaactcctgacctcaggtgatccacccgcctcagcctcccaaaatgctgggcttacaggcgtgagccaccgcacctggccttctcctttatttttctacaataattgtaatacttctgaaataaggggagaaataagggacatttctacaaagatgtggctcctgccctcagcaagctgacagcctgcaggggtcccacactggtgcctgtttggcttcaaccaaaccccagactcctccagggaggtggggacagggctcatcacccctgtgtgtcacaaggccaacgctggtgtgactaaagtggccaagaacctggaagagccaaagggccctcagtgcctttgtccagactcaggcctgcacagtgcgggagcccgtgtgtcccgaggcccaggttggaggagcggcctcatctgagaggcgcacacaccaggccctgacctgccccagccagggctccacacgactcttgctcagcaatcccccgactgcccaccctgcagaaggcggatgcaggcccagcgagcagacccctgctctcccctggcgctggcttcctgtctgcccaggaggtgagtaatgtccgctccctgcccccacgcatcccttctggaggccagacgggcctcacattttccgctcaggaaggggcagagtgagaggcctgctgaagcacatccaggggaaacggaaggagtggccccgcctgccgggtcaggaacctgggccagccccggcctgcaggaggcgcactggctcacctgcctccgtgcatgccttcgttcattttcatccactcattcattcaacaaacagcaccccagcacctgcgtggtgccaggccctgtgctgggtgctggaggcctggctctcagggtgcttatggtacttggggaggagactgcatcaaacagatcatcccacaggtggcggcgtaagtacagacggatgtgctgttcagccccaaggcaacgccagaccacagtgcctctggacaaagtctctcaggcatcctccctccacaccctatgatgtgcacagagccctgttcagacccaaaagaaagcccacgcctcagccggggcttggccgagggtctttaggggacctggcccgtgcctgggcaggaaactgtggcaggagctggcccgcatggccctgggccccaaggagggagcgccccaagtgtgtggagagggccttctttggttccctagctgccctgcccatcttctggggaccctcacacatggcccctgcccctgccaaaggggagagaggagaagcactggcacctccccaactctggctgagttgccccaagtctctccctgatcctaagtttcctccccatgagatgagggcactgtgagtggtgctccctgccaagcaccagtggctgtgatcgcagggacctgggagcatcccaggacttcagagtgtggggaactggtgtaaagaggtctgggagaccaagactcgcagccagtggcagggttgggggcagaagcctaactgtgtttcaggacaagcagacactcaccccggtagaacctcagaggcaagctcccggggagtgaaagctgtggcacccgcacaactcactcttgggctcagtttcaggacaagcagacactcaccccggtagaggctcagaggcatgctcccggggagtgagagtggacactcaccccggtagaggctcagaggcatgctcctggggagtgagagcagacactcatcccggtagaggctcagaggcaagctcccggggagtgagagcagacactcaccccggtagaagctcagaggcaagctcccggggagtgagagctggcacccgcacaactcactcttgggcccagtggtctccgccatgggatttgctctgccactcagccttcatctgcctttgttaaaatctttaaagaagggccccaacaaatccacagctgtagatctgtgctaactgcctggctccctgaaatcactcctggctggatcacttgtcagcagggatggggtgctgatatggttgggatctgggtcccctccaaatctcatggtgaaatgtgtcctccagggttggaggtgggcctggtgggaggtgtctgggtcatgaggggcagattccttatgagtggctgggtgctgtatggagtgagttctcactatgagttcatgcgagagctggttatttaaaagagcctggtacctcctccctctctcttgctccctctctcaccatgagacatgcctgctcccccttcaccttctgccatgtctgtaagcttcctgaggcctcaccagaagccaagcagatgctagtgccatgcctgtacagcctgtggaactgtgaaccaaataaacctcttttctttataaattacccagcctcaggtattcctttatagcaacaccaaacggaccaacacaggtgtgtcatcagcacagccttgggagtccccacactcccggcgaaaagaaaaggcccaggtactcagatgggaaggatgtccccagaaacaaacaacccaacttatcccccatcagaggcggagctccatctgctctgcaatggtgtgcttgggtaggtctcagtaaatgtttgttcgtttgttcattcggggataacagacattcagcaggtaccgacaatgggccatgttcgcaaccgagtcccaggggcagggcagagaccaagactgaccttacagcaggcctcagacttccacgaaggacggaaggccagagcccacacaccaagcccacctgggcatcagtggggttggggggcttctgcaatggagaccctcgggcggggagtggagcacacagagggctaaagcgggtgcctctgcttgggctgtccctgcctagtcctgcgtcaataacaggggcctgagagtgctctgatgggagccccttgactcactcatgggagctggacctcacatttctgcaccgtgagcaccttcaagaggggctggttgtatgtctccaggggggccagaagatggcccaggactctaggctggaaacccactgctctggacagacaccaacaggcccacaggcccagaagaggcagcagaggccaggccagctgcctgggccttcccaaggcctgtgccctgcccagggtctcagccagccagcggggtggcccacaactccatgagtgtctcggaggggacagtgaggcccacggccctgtggtcaacagcatcctccctgtcccagctctggtgtccatcaggaggggaaggtggtgtctgactaccccaggctgaccccgcactgggctcttggggacctacagaccccccagcctccctgcatctctcagcctcatcctcatggccaggccagccagcctctgggcagcaggtgctgagggaaccccatggaccccacagaaatgccactgtcagctacctgatcctgacagcccccaaatcaccagacctccccaggacgtgtctccaagagagatcacgctctcaaagggtggtcatgaggaataacagcatgagatctgcttgggaatgagtagggggaccatggtcccttcagccccactgctctgggtttctgaacaactgtcccagacccttcttgtgggggaccacagcctgtggccccagctgggctctgcaggcaccgccctcagtgttccttgggcgtggcctcaatcggctcagttgaggcgggaggtcagctgctgcgcttgtcccagccccagagccccccagagcacgtggctgcccccgccggtccccacccccgtgggaacgctggaaggcggcactggcctgggaggctggcagcacgagggggtcgcaccgacctcacgaggcatcaagcacaaaagccttttctttgccggcagccacgcaccccactcctcctgcagccactccctgtgctccccagcccctggcccagacacctccagctgcctccagactgggtctcctcccaaacaaagccggattcaggccttcgggaggcaggcgcgcaggttctgccatggagatgaactttgacccaaacagcaaggctcctaccccttatttactctttaaggctgacccgtttcacagagttcacattacacccctttttaatccgcacctccctcccacattccaggcctcgaccttcaacccctcctaattgctggctccggctcctacaccccagttcttgggcccagctcactcatccctgcccccaaccatctcctccacggaaacaaaggcgatgctggggtgctgtgctcacagggccacctcacaaccctggcacaccaaggtagatgccagggtcccagagcccaaccacttgggggagtccacgtggaggccggggtggatctttggggtctgattcctgaccctaactctccaacccctgagaaggaagcctctattccaagggaggctggagtaggctgcctggcaggccctgcgcggaggcggtcagggctagggaagaatccggacagctccccagccagccgcatcgcatcccaaggggctagggtgaatgtgggcagctgcactgcctggtcactcaccaggtgacctgggctatagcctcacatgtggctgcagaaacacagcttgtttcccttgctgggcagcggaactgctctgggttaggtacactgtgaaccttcccaggcctgcccctggtaactctgaaacccacattgcagaagcccatggcatcccggcaaccaggcagaccccccgccccgcaggctgccagtcctatgggctctctccctcatctttgggaggaaggagccaggagctggggcactggggcccatggagatgctgagaacactgggggcagtgcaagcttgggcctgagccacccaaaggccttggcccagattccgccaccctggagtgtgtccacacctctcacctgaggacaactgggagcagggggccgggcacagcccctcctcaactgccaccaaggggcactcaccgtcctcttgactgtggaggttctgcgggctccgcatcctctcgtcctggctggggctcaggctggaggccaggtgcgggtcagctgacatccatgtggagtcgctcatatcaaaatcctcgctgctcacagaagtctcatcctgagcagggacaaagaaggtgggcattcagcagggacgggctctcatcagcctgaggcagccttgtgggtggaccccagggccagtgggcgtttgggagtgccctgaaggcggcaggagccctcaaaccttgaagtgagggctgggtggtgctcccccttgcccggtggaagtggccccggctctggttcctgtcggaagccaaggctaagggccggcactgtctgtaattgaagacaattatgaggtctcgcatcctgcaggggcggatggcagggcctggctcttacccttgtgagccaaggttgaaacaagcgctgtaaacaagggctgccgctccctgctctcagcccagggaccggggctcactctgcacaggacccggcggcaagaagcgggcagcagcacatgcccgccaccaggcactgaggctgagctgagtgcccccagcaggcctggcgccctgactcccatgaagcatgcatggaattcctttctcccactcccccagcccagaggacgtttctgtcttcctccttcctaacctttgctgtgcttcaaagatacgctcttgggcagcttccagggctgaaagggccagccccagaagtgcagagaaggaagggggcggggcaggccagggttcggaccagaccgcaaagggggttcagctcaagggcctggggggccgccagggcgttccaaacagccggatggcctgctagagaggaccacgcctgcctcctctctcctcgctgccggcttcgggccggcccttggccagtcatccgggaacccccggggcggggccccttcaacccagccctccagggggaagggcccccacctcctccaggcccagcctttcaggagcagcaagcaactgtgcctgggagctggctgtaaaaccaagaaagatgacccagcagctcccacacccggagttctggcctccccccagcaagacacaatggcctctgtgggcccccagtgaggacctctgacagagcaccccccaagcctcccctccggggcccccctcacagacacctcttttatagtgagcaaacacactttggttggaactttcttagactgctgtccctgaggcagacacatctgctccaagtgctagggaaccagtgtggattcgcctccactccctcccccaccggctgggctggtagggagtttcctggaatttatagcttctgtgcagtgtggaccctctgctgaatccagaggacaggagctgggctgtgacgcctgtagtccccacgcggcacacccagggcctcgggggatggacagagcccacgtgtcctctagtgtcctctccccacacacaggcacacgcactcactctgcctccctcccacaggctgcctgctccataaacacaagcacctccacccacagccctccttcgtgaaaactcgctcacacacccggagggacacacacacacacacacacacacacacacacacacacgttcaaaaggctctgcacaaagggtacaaagggacaacaaaactctcccctgtgctaactggatggagggagacgaaggggagggggaagagaggctggcaggtgggggaaggttccttggagccttgagcaaggctgcaaggtgcagccggctccccatcttcccagctggtcgtgccatgcgggctccgggaaccaggaacggggcatcttgcatgggccccttgctacttcctggatgcccagggggtgccatgctctgggtttgacctgaagtcacagctgaaggaggaagactcttgggtattgttcaaatgctcacgacttaaaagacagagtattctagtaacagttgaaagtgccacctactccaaactccccatccatccattcgacaggtatttactgagcacctgctatgggccaagctccgctctaggtgctgggaaactcagctgtggaccagacacactcctggcctgcctggcacccctcgatccacgagggagatggacaatgagcagaaaaacattgatgacggctgcaaagcacatggaagcagggcaagagggcagagggacctgtttgccagggcagcccagaaaaaccccacgggtcagaaatgctggagcagaggcctgcgagaagtgaggaggggagcccatgaggtctgtgtggctccacgcaagtttcaggcacaggcagcagcaagtggggcacaagctgctgggtttgaggagaggcaaggaggctgctgtgggcaggcatgggcgggcacacggggacagaggagccacacgaaaagttcccctcccacagtgcacgtaaccctggcagggccgtacctgccatctctaggttggagaaaggctcttgaactccactcaatacgcacactctggcctctctcagccaagttcaaaccataacaacagaaggcaaagcttctcaggggcccagcgctcccctggacttgtggtatttcaccctcactacaggtccaccaggtaggtacagttgacagccccgctccacagatgaggaaactgaggctccaggaggttaaggtgctcgcccaaggtcacgagctaacacgaggcagagccagatctgtgcaatcgccaaggactggacacgccctcctaactgagttggccctcgcctagaacccacactgctgctgtgaaccacaatcccaattccaagctgtatccagctgtcactgtcttgtgggtctctgccctgtctttccctggaaaaccttcggtccttccaacagtggggaccagactgtatgtcctctgaatcccgcacaaggcagtgagacttgttgaatcaactgaattgcctggcatagtgttggtgtttaatgaggacgctccattaatttgacaattaaggactctggtcccattgcgcacagttcttgaatggagggcatatgaagcccaggatgcaggctggtgggctggtggcaccctggtgccctgcaatgcctccctcctgccgctgccagccaccccacacacagccagggtttctctggctcacatcactgaactgttcacccaaatgccccctccaaccctcactcccttgatgggtcccactgggaaaaggtgggctacacctaacctggcatcaaaatcacctgattaggaggagcacccagtgcccacaggcacgggacttcaggctaatggttttattagatttcctcccatgaccccataacacaggcacccacgtcaggcctagctccagctctgataactgcccctgcgaggcccgccccgcctgccccaactgcccaggggcacgaagccagcagcacagctggtgtgtagacccaggcagcctgtgcccagagcctgcatcacactgtcaccgcaccatgggccacctcaccacatctcctcccttcaatgggaggaaccagattccttaacaaccaagtgtctcaagatgaggcccagagggaactcatgggtgatgaggctatatttacacacacacacacacacacacacacacacactctctctctctctctctcatgcatgctcactttcttcaatgagttgttgcacatttattgagcatctactatgtgctggcactgtgctagggacatagataactaaggcagggctcctttacaccaggccttgttagctaggaaaagggaccagcaaaacttctgacccacctgtaggtgcagtggggagacactgtggacacactgcctagtcacctaacgatgactgctttctccccagctccccaggaagttttcccacagcctccagggttctgccatgtggaccccagttttgtgaaaagtggttctaagattctgatatcttgactgctatagcttttttgaaagacaggatcttactgtcacataggctggagtacagtggtgcaatagtggctaactacagcctcgaccccccaggctcctgcctcagcctcccgaggagctggcactacaggcatataccaccacgcctggctaacttttaattttttgtagagacaagggctcactatatcgcccaggctggcctcgaactcctgggctcaagtgccttggcctcccaaagtgctgggagtgcgggtgtgagctgccacacctggctgcgacagcaaattttttttaagtgagaaatcaagtctattaagcctaacttttcaaaaacacacaatacaaaaataagttttggtcagacttacacaaacccttcaacacccagactttcaagggctgaggtagagaagaagacttcccaagacccctctgcaacctgtctggcgcagcacagcccagttcatgggtgtaagcccccctagccgcagatgggcagactgtagctccagtccctcactcacaccctaagccaaggctggagaagcaggctaatcacacaggcagttacaagtacacacagatcagaacccgtcaacgacaactgtgcagagggggaaaatacacccaagtccagagggccatgctggaggcactggtgcaggtttgagagtggccaaggcctcaggcctgctcagagacccaaggtgctcactggctcacccagaggtcacagggcgctttttacttttcccttcaggaatctcagatgaattgagggctattttctccctttctgttaacaaacttcaacaaaacttacattagagaataaaagtgtgggctgggtgtgatggctcacacctgtaatgccaacattttgggaggctgaggtgaatgaattgcttaaggccaggagttcaagacccacctgggcaacacagtgagacgctgtctctatttacaaaaaaaaagtgtgtgcaatccattacttctgggttccctctccccagtccccatgtgactggccagtcagctaccccctggtttctctagcctctgccctttggacaccctgaagcccgtggccttgcccacccagcaatcatttattccagcaccaaagccatcatgggtcacagggtaacagagccaaagccaaatgctcttctgaaaagggaacttaagagttaggcaggcagatgggtagcacccagtcagcctctgggacacaccccaacctgggagccctgcctctggggcagagggagaggagctgaccagactctccctgctcttatcttcagtccaaaattcatggacaggttcagtctctctccacccagcttctgaggcccttcctcttctgcatggtaactagcacaaccactgcccagcccaggaggaggagaaaacgggagaccagaggggaaatggtggaaatgggcctgtatccatggcttgtaactacgggcaggtgctatcagtaacctgattattttacaactggggtcaatttctctggaactgggttcctggtgcctctgaagttgagccatttgcatcctccaggacttgggatcctggggcgtgcctcacacggtattttccagacccttcctgagagctgtaattctatctctacagcttgcttgagaaagaaaaggaggaggatttgctgagaatttagtgcaattttaagccataagccctgaccaggagccctgggtgtgtgtttcagaggagggcaggggcagggatgtgcaggggatgtttctgggccaagcaggaaagagacccctctctatacagcccccaggcttgttcgacaggaggctaaagctcccactgggaagaacaccagcctcagggggttgccccagcaccagctctatcccaaagcggagtctcttctcaacccactggtgggcccctccttctggacacctgtaggccccttccaggccctggacattcttccacacgaggcgactctcccccttgtctccatgtcagcgagcattacacacgcagccttctgagcatgccaagaaggtactgaaccgcatgtgaccccaacttaaccacttcagttcatcagatggcttattaatggaagacgaaaaacccccagcatctaaagcaacaggggttcaaatccttgttgtgaaggagccgcacacatgaaacaggagggtggtctgagccacagctcctggggggtgtggggtcccaaggctgttgcttcatggctacaccccaagcccacctagccaccagggaaggaggccagccttccagcactccctgcacaattccactccttcctgcaaacatgcctcctctgcttactagccatgcaagcaccagctcttctgggaaatatgaggcaggaagggctgagacacagccaatcacctaccacactggaggcattctcgctctctctccctcacactcactcacacgcacactgtgtctgtcagaagcgtattcccatctacatgtggtcctctgttgtccctgctgtcatagacacctggatgctggaagtgagcatttcccacaccttcccactgtatatcaagtggaaaacaggcttttgttcctaagcaaaggcacctggctgctccccatcagcattcctcaccacgagggcctcgctggtaccctcagaccctgccattaatgggggtttctttaaaagtgaagctggagagaggagcttcagcagacagggatcttccagccaaaaggaaggctggaagggagccgctgtgagctaatcccctgcagggctgtccttccaagaaaggaacccagacaacacagaaaaagttcttgagcaattcccaggcggtccagctccacagagccccagggtaggggccgcaggaaaagttccccaaaggcgtcttctcagctgggaggaaggccgtcttctcagctgggaggaaggccgcagtgagctctgttcccactgtgcggcaggaaggtgctgaatagggtggtgtcgcccagctcaagaggtgctgtcttaaaaccctgctctataaagcaagcccagcctgagcctggattagacaggagcttgatattattcaaggacacatttaggccctaatggctttccaatgaaggggtaatttactacccggggggctaaactaccacagggcctgggccataaacgggccttttccccagaccaactcagtccagaatccggcctgtgtcaggggtcaagacaggggcctggtcccatcacacagatggctctccccagaagagccatgaggtcccccaaacacctctccccacaccccctttggtgtgtgtgagttggtggggcggggcgggggggggggagcaggctggggttgccagctgattctgggataagtagggctttatctcaagggagaatctatttcaagccacaatccttctcagaaagaggaggaaatcacagagtccaaacaccatttcaggtgaaatcaggaggttattcatctcccctcagagcagacagaaaggaaaatcaatgttttagagggggaaaaaaggttccatttgaattaatgggtttgtggcttctccattgatctgagcctcttcacactttctttttgtgcttttgtgctcttggggagaggggagggagtagggaatggggaggagggggtgggcctcccataaggaaaaggacggtctaaccttaacctttctacaggaataatgctaattagcgaggcttaatgagaacttcccccaggaagcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccgaaaagcaacactctcatcaccaaaccgcagaattagaccccgatggagaaaatgggtcaggggatccattcccaccccacccctccaaatccagaccctccgctaccacagatcagcctcgaaaaaagcttgtgcttcaacaaggatggggaactgccctcgtggaattctgtggggaaattgccaaaaaaaaaaaaaaaaaaaaaaaaaaaaacaactaaaaaaaaaccctgataaggatcccacctcctgattcctctggtcgcatccgaagaggaagggcaatttctactgactctttacgctaccattcattcacggtggaaccagcagagaagagaaaacgagacagccacagcgattgtttgcaattttgaaacagactgcctttaaccctccaactttttttctgtaaaaagccttttttctttcttcctctgaaagctttgcattgtgaacaatccatggtaaacaaggctccctctacagccgcgagtgcgaagtacaaccccacaggttcagagcccagcgtttacccgtcagaaaaataaaatgatgacaagacatcacattagcgccacgcaggcttccttccgcacatgctcaagactctgctgtcaatagaaaactcacactttctttttaaaagagggtttaggcacatttactcatttgcaccttttattcctgaaatcaaatgtgttttcaaaccaattcactctccccagtttactggatcttctcatccttggtgatgtggggcaggtgggaggctttatttatccacacatgctggtgcccaataatgatttttagaacgaactagtggccacagctcttaagttcatccaggaaatgtgtttccaaacgcgggaactgtccatcctcactctgaaaatgagataattcagactcaggatttccctttccccaccacattttcagagacctttgacttctcctggcctgaattactatttcacagcagtggtggacatctgagcttgaaatataaagccaaatacaactgaagttcaaaggtggaattgaacccagataacccacctcttctctgactaataaaagagagctagtaccgcccaggagggcagagcagtgattttctgtaggcatgaaacgtgaactcatttactatccctgagataaaacagcccagccctgctcaacccacagaaaacagttgagagccctgcagaaacctggctgttgagcggcactgcaaatgaggtgagttttcatgtgtgtgtgctgaagccctcagaaatctcccagatccttattcctacaggagctgccactcctggagtaaccttgtataggttgttttcagtgtccttgtgccactcccccactccttaaagtggccacagcatgagtcccaatgaggaatcgggtgacctagtttcttgaccactaattctcccagtgatgtgtcccttcttctggccccagcctggtaggagaccatggcagagaaagctgatcccatctgcttcggggggacaatgctgccacaggtcccctccagcctctgaagacattgggtgcttttgtaaacagatgattagggtatgctctgatggggctttttaagcagcaaacccctttctttcatgcagcttcccatatgaagtaagcatgtcccacaagtggggacctggccatgggactctggtttgccattattaggacaaataggatcttagcgtgaccagagcagacactgttcaagcacgtcaaaacattaaaaaaaaaaattatccccacaaatgacttattaatgacagagaagaaaatgtacctgcaatggggcgatctggcagacacttcccaatcaagtcatcaaattcagcagcctccaaagtggggccaccagacatgatgtcctcggctcctgaagggaggcactggaagacacagcatcacttgagccatgtgctcccccaacatgcttcacctgaatctgctcctcaagagacaaccagacaagaaatccagaaagagaaactccacaacacaacagtcttggactctacaaaacattcattgtcactaattgactttctaaacgataagatgaaagagaaataacagccgggtgcagtggctcacacctgtaatcccagcactttgggaggccgaggcgggtggatcacctgaggtcaggggttcgagaccagcctggccaacatggtgaaacccagtctctactaaaaacacaaaattggacgggcgtggtggcacacacctgtaatcccagctactcgggaggctggggtaggagaattgcttgaacccaggaagcagaggttgcagtgagccgagatcataccgttgcactccagcctgggcgacaggagcgaaactccatctcaaaaaaaattaaagagagagaaataacaactaaacttaatgtgtgactcttcttagatcctgtagagatggaatgaggtgtggacaaggggtgggggagaggcagaggatgggggtggaatgagggtgggggccagggtgggctctgggctgagtggtcagggaagagctctcccaggaggaagccactgggtgtcctaatccccagagggcagaagttgacagctgggtgaagacctgggggcactgtcttccaggcagagggaatagttggtgcaaaactgctgatgaaaggaaaggtgaccagagtgctagagcaatgtgggccagggggagggcaggagggatgagcatcgggggggcaaacagggccaagcatgcaacatcctgaacatcccccgtgaggtgtgtgggctttacactgggagtgaggagaggatgcaatctgagttacgtttttagatcaggggagatgagattataaaggagcagaagtgatgacagggaggccagtgaggaggtctaatggaaagagtatcatcagatggaactagttcaaattctggctctgacactagatggatgactttgggcaccatacctaaacctctctaagcaacagtttattcatctacatgtgatccacagtttttgtttgttggttttatttttttttttttttgaccaaatcttgctgtgtcacctaggctggagtgcagtggcacgatctgggctcactgcatcctccacctccctgactcaagccattcttgtgtctcagcctcccaagtagctgggattacaggtgtgtgccaccatgcctggctaatttttgtatttttagtagagatggagttttaccatgttgtccaggctggtctcaagctcctggactcaagtgatccacccgccttggccttccaaagacccactatgtttaacgtgtgtttaacgtagcatttggcaccaaattttcctctttgagattacaaactgtggtagacagtctccaagatggcccatgatgaccctcaccgcccagtttcataccctggtaccatcgcaatgcacagggctgtggaaccaatggtgcattgtggaaatgagggtgtgtgactgccaaggctagatcctaaaagacatcttgatcttttccccagagggagtacttggtagatggtagcttttatcatcaggattgtacatttcataattgcacaatcggggtcacatccctctctctaaatgctacactagtttactctgccaccagcaatatctagcagcactcatttcactgcacacttgtcactgcttactattagcaatctcttttatctctgtcaatctgagggaggaagaacagtgtctcttattttcctttgctcctcttcacttgggaatgtaagtagatgtttctgtgcactgtgtttacggggcacttgtatttctttttctttctttcttttctttctttcttttccttccttccttccttccttccttccttccttccttccttcctttctttctttctttttctttctttctttctttctttttctttctttctttctttctttctttctttctttctttctttctttctttctttctttctttctttcctctctctttctttctttctgactaacctgttcatatcctttgcccatttctctatttgaattgttggtctttttttttttttttttttggtaagaactttttggaaataaggaaaattaatcttttgtcatgtattttgcaaatatgttttccttttgttgtctttttatttagtttatgacaagatttttttagccatatggaaattttacatttttatatcatctgattttttttttttcctttagggctttagggcttcaggttaaaacaaaagcttttttccactctaagattacaaaagtaattcacctatattttcttctggaaactttatgtcttcattacatttaaatctttattccatcttttatttatctcaatataagtaatgaagtggggatctggcttatttttttctaaatggctttctaagtggtgtcaataccatcttttatcttttattttttatttttgaaacagggtctcactctgttacccagactgaagtgcagtggcatgatcttggctcactgcaggctcaatcccctggactcaagcaatcctcctgccttagcctcccaaagtgctggaattacaggcatgtgccactgcacctggcctaaatatcatcttttaaataactcatctttatccactaattggaaatgtcatcttatactaattttctattatgtgtggatttgtattatattctgttgacctattcctgtctcagtattatggctttaaaatatgttttctgggccgggcgcagtggctcacgcctgtaatcccagcactttgggaggccgaggcaggagaatggtgtgaacctgggaggcagagcttgcggttagccgagatcatgccactgcactccagcctgggtgacagagtgagactccctctcaaataaataaataaataaataagtaaataagttttctggcctggcatggtgactcacgcctgtaatcccagcattttgcgaagccgaggtgggcagatcacttcaggtcatgagtttgagaccagcctggccaacatggtaaaaccctgtctctactaaaaatacaaaaattagctgggcgtggtggtgcgtgtctgtagtcctagctactggggaggctgaggcaggagaatcgcttgaacccaggaaggggaggctgcagtaagccgggatcatgccactgcactccagcctgggtgacagagagagactccatctcaaaaaaaaaaaaaaaaatatatatacacatatatatatgtatatacacacattatgtatatatatgttttcctactaggtagggctagcatccatctctaccccataaactgtccctgctcacaccataacaaaaataattgaaacagtgtcacagccaaggggtactctaggtacagcatatttatggagaaaggagagatgtttctcctgggggactggggggtgagagggaaggttcctggaagagatgacatttactgtgaatcaaagaagttgggaggcttgcgacaggtggaaagtagggaggcatccggctggaagaggaggatgtggagaatccagggcttcacaagtgcctggattcaaaacacctgacctgtgggctgggccatagcgctgactatccatttattctttatattaactgatttttgcatagctgcctgcaacctcacagtcagtttgacacctttgctgaaatctaggagaaacagtccaatactatttcctcattcttctctatttagataaattttccattacgaatacaactaactgagcctgacttgttgaaatacattctcctgaaaaccatgataaaaggtaaaaattacaatttcattattctccttttcaaaaagtcttgctttaaaatgtcatcagttaattctggtcatgtcgctctcctattccaaaaccttcaataactcccagtcaccggcggaatcgagttatagctctctctggtctggcgttggaggccccactggcctgctggccttatttccttctgttcctctctgggaactctgtagcagacggactcgccatcttttgtcccctagtcacccatgtgcgacccctccatgcctttgaccacacatgtttttaggcctgtgttccttccacacatatgtacagagccactaccacacaccaggcgccatgacaagtgcaggtgacatggcaatgtacaatacagactcagggttgaccatagggagcctccaggccagcaggggagagagagattaaacaagtgatgtcatgggatcctgatctgcatgctggtcatgggcggtgtattccagtttgtacttgatagtcctgaaacattctaggaaggaagtccccagggtgtgagaaggaagtagcagatctgggagggctccactgaggaggtgacatttaagttgggcactgaaggatgaatgggtgttcatgaggtggaaaggtgcctgggctgtcaacaaagacaccttccacctcagccaaatcaagatccctccacagactgccgcccagctggctctgaactgacgcgtttgtggtactttctgtttcctgcattaacttcattttccgaactgggccattcgctctgagggctgggacaggttcttagaagagttaccctgcacacagtagggatgcatcactgcctcactcgggccccttcctgcccactgccagcacagctctgaagtcttcgatagagctcagaatgaagcgggccatcctggacacgggccacactttgtaactcccatggggcatgcacatgcctcttttccctcccttctttcctggtgcccttggagaggctcagagaaactaccaaggccagccacaaccctgcatttctacttgcaggtgtgtacacaataaaatgaacacagatgttccctaaagaacacacagtaggctgggcatggtggctcacacccataatcccagcactttgggaggctgaggtgggaggatcacttgaagtctggagttcgagataagcctgggcaacatagcaagaccctgtctctgcaaaaagaatttagctgtgcatgatggcatgcacccgtagtcccagctactgtggaggctgaggtgggaggattgcttgagcctgggagatcaaggctgcagtgagctgtgattgtgccactgcattctagcctgggccacagagcatgaccctgtctcgaaagacagaaagaagaaagaacacatagcagactggtaggctggtcatagcagcactattcacaacagctcccaactgtccaccaatgaaggatggatacattgtgggccccccataccatgaaatattactcagccataaaaagaaacaaactactgacgcatgccataacacagatgatgctcacacacttatgcttgtgagcaaacgagcacatgctgtacaattccatttctataaagttctagaacaggcaaaatcaatgtatgctcctagaagtcaggtcagtggtcaccctggcccaggggcagtgactagagggagcacaaagggtctttagggtggtgctgatgttttgtttcttgatctggacatgggtcacaggaggtggggtcagtttgtgaacttggctgagctgtgaaactgagtgatgcgtgctcttttctgaatgtgcattatgcttcagtagaagtttcaaaaggggaaacagcaagccaggtcagcttccatggctaagcagcctggagctcgctgtagtcgattactgcaacccactggacaccaggcacctgtgctgggcagtgtgtatgtgttatcttatttaatccaccaaataacaaggttgatattcatttgccattgtgcacatgaagactaggggcttctgggagaagattaagtgactcacccagtcacccaagagtggagaaactggcactcagagagcaggtgacacgtccacaatcatggagctagaagctgctggctgtgctggaccaagatgtgtgggtctccagggtgtgtggtgggccctgctaaggtgagaccactgagccaggccacgtggtgctgcgcttcaccgacctccagcagagcaggaggaatccaccagtgcgagtcagatgcagccagagatttcccttgggccaagacctgggaatgggctaggactgctgtgaggccctgccttgggatggaccccagggcttctccatacaagccttggaaggaggctggccttggaagcctgaagggatgaaactctagctggctctccggcaggtgaggagaggtaaggaccctccacaggctgtgggggtgtgagactaacttacgttcactcggtccaaggaagccatgcagggaaacgggcaggttaccaagagaaagaggcaggcagcaccttctgcctaggcctgcagtcccttcatgacagagcccacagctccggtgtggatgatggcccaaggctctggggcccgggatgctgcatggggacctttctggggctgaatctagtgtgtggggtcatgtccaggtgtggaggggagtgggcagctgcggacacgctctgtttgcactcaggcccttgctcggtgtgacctcaggcaggtgacttgactctccaagccttggtttcctcatctctaaaatgaggaaacaacagcagggacttgtttttgaaggttgcagtgaggcctaaatgcagcgatagctgaagaggcctggactggtgctgggcacagagcaccgcccgaaccatagttatggatagtgatggtactacgaaaactaagtaataactcagtcatcagtccacacgcatttattgagcccctactatgctccaaggcccggtccaggtgcagggactgcagtggtgagataagcacacctgggtctgtccatgtggagccgatggtgctggtgctgctgcggcctcagcttgtccctaccctgactgttgctttctttttcctttctctttccccaccccttcccttgagaaataacagcattaagattggagagactagggctctctttcttactaattctgtgacttcagacaaattactggctaggcgcagtggctcatgcctataatcccagcactttgggaggccaaggcaggtggatcacctgaggtcaggagttcaagaccagtctgaccaacatggtgaaacctggtctctactaaaaatacaaaaattagctgggtgtggtggcacatgcctgtaatcctagctacttgggaggctgagacaggagaatcatttgaacccaggaggtggagcttgcagtgagctgagatcatgccactgcactccagcctgggccacagagtgagataatctcgggaaaaaaaaaaaaaaaaaaaaaaaaaaaaacacacaacacacacacacacacaaacaaattacttaagctctctaaagccgagcctcagtttccctgtgtgctgaggaactgagttctgtgtctgggggtacccagcacacagaaggcccccaacaattgctgttcctgctcccctgcctacctccctctcctctcttcttcctccccactttccccgtttcctttcttttccattctttttctctgcccaagccttcggcatcttaacacccaaagtgattgtcaaagtttagttgatggtgcccaggctgtggcagagactgtgaaccagttttcttgatattatgccctgaatcaacattctcccttatctttttcaaccacagagggtagaaacatgaaattctttctttcccagcctcccttacaactgggaaccacgtgacccttttgcagcaatgagacatcaacacaatgcctcgaatgtggacaaggttggagcaatagcaggcaacttgcaaccatgaggaaaagcctcaataacatcacagagacaccaacccaacattgcaaatggcaccagcggcggctcctccattcttcttgttttaggagtaaaataacttcatgttttgctatagtcaactgggtttgggggcctgtagtcaaaagcattcctggcttattcacatggctcctgtccgcgggtggactagatggcaaggatcccccactcccatgtggccttttctctttcaagaggacacaggagcctcttgactctttgaagaggacacaggggtgctacgctacgtccaggcacctgctgtgcgtactgtggtgcctggggagcagacaagcatttagttccctcacttgtggactctgaaggagggaaaactgtcacggctgcagcacaagtgtgcctgggcacttcctcagccacaggagtatcccagttaaagaacatcttctgtttctatcttatctcttgaggtatttagagccattctaaatgccagagccttagaatgaccatggggctggcagggcatgggctctgtgactcatatctgtcgaggaggctgcttgtggttgtgctggatcgagcccctctccttgactatcttcggcaccgcaagccaaagctcagggctgcccgggcctattcctgaggtggtgcaggagaggcagatgggctgctggggacgaaaggggtaggtaggcgggctctgggctccgtgcccagcattgccagcaacatgcctgtctgctgctgacccctgacccactcaacttcctccccagaagacagtcccttgaagaaaggggttcctccatcaaaatgtaaaatttgaaagccacagatgtctgacccaaacctgctgatctagtaacagggaagctgcagcatgaagaagttagatggctggggcgcagtggctcacgtcccagcactttggggaggctgaggtgggggaatgcttaagcccaggagttcaagaccagcctgggcaacatggcgagaccccatccctacaaaaaatacaaacattagctgggcgcggtgttgagcacctgtggtcccagctactcaggaggctgaggtgggagaattgcttgagctcaggaggtcaaggctgcagtgagctgtgatcatatcactgcaccccaataaaagaagttagatgactcgtggggcagaggcacacctagaaccagagtcgctggactccctctcaggtgctcatctccactttcgacctgagacaggcccaggtccctgccctgcttccctctggcagagaaagatcaccactaggcttcacatcacaacacatgtgcacccggctggcaggccctgggagagctgcctttgaagacggctcccaggcatagctcccccttactcctctatctgagccccactgctgttcctaccccagggtctttgcatgtgctgtctcctgtgcctggaaagccctcccacttcatctctgcagggctggccacttctcaccattcaggccttggctcggatgctgcctcttcagagaggccttcttgccctgaggcacagtctgtcatcttactctattttaattatctaccccaaatttcctccttttgcatatttttttatattgccttgtttatcatctccaggcctgtgagctcctagggatgggtaccttatctgtctcattcactgtggtatcttccgtgcttggaatgacctccagcatgtagtaggaacctcggaaatgatttttgagtgaaggaaggaagaaatttctttctttcttttttttttttgagagagtttcactcttgttgcccaagctggagtacagtggcatgatctcagctcactgcaacctctgcctcccaggttcaagtgattcttctgcctcagcctcccgagtagctggaactacaggtgcctgccaccacagctggctaattttttgtatttttagtagagacagggtttcatcatgttggccgggctggtctcgaactgacctcaggtgatccacccgcctcagcctcccaaaaagtgctgggattacaggcatgaaccaccacacctggcctaggaaatttctttaaaactacataatgctgtgttgcagggaggacaagggtctggtcggccgtgagcagcagctgtgctgtgtgcctctcagtctgaataggggtcggggagctacccgcctgccgggatccacacccagtcaccccgagcaaaacaaagcagacagcacaaattcacaaagcaatactgtgccctcctaccctcaaaaaaaaaaaaaaaaaaaaagcccgataatgaggtaaacacaatcatgaccaggaaaaagcttggccatgcttcttccagtccacccaaagccattatctctaattgatctccagacatcagctgctgaagcgtctgaaaccctcctgcaccctccaggtctggttacaaagccctggcccacccacccgccccatggagtcaggtctcctggagctgctctttgctgggggtgacagggcctatctgggccccacatgaaaaggacccatcaggctgacaagagtcagggtgggtcaagaacctgtgtaaaagtcacaaccactaaatgctcagctgccagggggctgagctgcctgagtttcagtgccttaagtagaaggcttgacaaagccatcaggggtcccgcattcaaaataaaaagcaaggaaaaccagggacggctgcagaaaagcaccctgcccaaaatatcccactagttctgggtgaaagaggcacccaaaagctggagtgaggagtttagttgcaaaacggaacgggacttagccacaagatcacgaatcccttctgggtcttggttaggctgtggcggtcacaagggcagccatcagtacagggaccatctggatgttttgagctgctccttcctggcccagcccaggaaagacgtctcctttcctgttaggtctctcttgtccttagaaacagaccggagtcagctccctgggctgcctggcaggggtgttttactgccagagctctgacaggacagagccacttccccccttcattcatggacgcccaggtagcagctcctgacctgtgcaagcttttcccttgacacacacaaagcgtcccgaggccagccctgcatgcagtattgctgcttatggcaccaggcagctctcctgcttgcaccagtaaattacgagtgcttcctgcattttttcccccagataataaagttgaaaggccaccttggcattctcgcatttgtaggggtggaggtctgcagcccggaaggggctcgagcctcaaggagctgctggggacaatgagctgttcaggttcggggtatctgccaaccccaccagacactggctctccagacagggtggtggctgttttccactttcccacacagcttcagggaagtgagaggaaagaaaagacacagacctctcccagctcaggttgccctcacaaaacagaggaaatgctcattttctgtgagaatttggaaattgtagtaagtttctagaaagcaccccaggatgttcaagaacatatactgattgcaaaaataatgtcccataacaaaagatgtttgacaatgagcttttcacgcctctctctgttctcttaaaaaaaaaaaaagctttctgataaatcattccctctcaagtttagaaatgccctattttcacagggcatggtggctcatgcctgtcattccagcactttaggaggccaaagtgggaggatcgcttgagcccaggagttcaagaccagcctgggcaacacgtgaagccccatctctataaaaagtgcaaaaaattagccaggtgtggtggtgtgtgcctgtagttccagctactcgggaggctgaggtgggaggatcactagagcctgggaagtcgaggctgcattgagctgtgattgcaccactgcactctaccctgggcaacgggagtgagaccctgtctcaataaaaaaaaaaaaaaaaaaaaagaaatgcactattttctttgggaggcccagaagttcaagatcagcctgggcaacaaagtgaagcactgtttctacttaaaaaatttttgtgtttgtttgtttttgaggcagagtcttggtcttgctctgttgcctaggctggagtgcagtggtgcaatctcagctcactgcaacctctgcttcccaggttcaagtgattctcctgcctcaacctcctgagtacctgggattacaggctcctgccaccacgccagctaatttttgtatttttagtagagacggggcttcaccatgttggtcaggctggtctcaaactcctggccttgtgatctgcccaccttggcctcccaaagtgctgggattacaggcgtgagccactgctcctggccaaaaaaaatttttttttaaataaatgccctattttgcatgataccattttaggaggatggggaatgctgtgctgtccatgtttagagccccccgatcctgacactgggctcatggtgctcctggttctcagtccacctctgtttgtcagtgaacaaagaggcctgggataaagtgtcttcacataatgctcatgtggtcagatcagtggtgctgctgcagtatttttcctccaccaaaaagcggatacaaacatttttaggcattaaagaaacaatttttggctgggtgtggtggctcatgcctgtaatcccagcactttgggaggctgaggcaggcagatcacttgaggccaggagtttcagaccagcttggccaacatggtgaaaccccatctctactaaaaatgcaaaaattagccgggcatggtggcaggcatctgtagtcccagctactcagtcagctgaggcaggagaattgcttgaacctgggcagcggaggttgtagtgagccaagattttgcgactgcactctagcctgggcaacagagggagaccttgtctcaaaaaaaaaaaaaaaaaaaaaaggaacaattatttttttcaaagtaatgccttttttcaagccagcaaaacttttaaaaagaaagccaacaaaagaggaacaattcctactagatattaaaacatatgataaagttttcacacttaaaacagtttggtagctgctacatgaatagtcaaggagcccagtggaccaaacagaagtagattctgttttggatggaaacttagtaagttttaaaggtgtcatctcaaatcagtgggggaaaatggagtatttaacaaatgatgctgagacaaaagggttaagcggaatctgtatctcagaatacgtcagcataagctccaaatggatcaaagattaaatataaaaaatgaaaataaaaacatgtatgctttttgctctgtcagctggaagagcctgcaagaaaggatacttcagtaccaatgggcacacatagtgcccagatcttgtttttttgttttgttttatacaaaatatatagagatgaggtttgcccaggctggtcttgaactcctgaactcaagagacccttctgccttggcctcccaaagtgttgggataatgggtgtaagccaccatgcccagccagatttttttttttttttttttgagacggagtcttgctttcttgcccaggctggagtgcagtggcacaatctcggctcattgcaagctccgcctcccgggttcatgccattcttctgcctcagcctcccaagtagctgggagtacaggcgcctgccaccacgcccagctaatttttttgtatttctttcttttttttttttttttttactagagacatggtttcatcgtgttagccaggatggtctcgatccgatattttggtttttaatatggttttccaataaaaggaatcagagctccttggagaaatcactgattccaggattggggcaggaaatatgcaagatgagcctggagtcttacagtgccagaaagcaaagaagcactaaaaaacagaaacgaacaaacaaaaaccccaaacaccaatgaggtatggcaaaagagcacaggaaacaactgaaaaagctccaatggccaaagctagaacaatttgtacaacaaaatgaagaagtattgaatgatcatcaaagcataaaataaacagctatgagtctcgacttctataaatggctgaataaattaataagtgggggaggagaaacaaatctcctatgcataagcaatctaaataatttacgttgataattcaccctaaaaaaggcagaacatgactccccactcttcaggtgtgggctgcacacggtgccttccttcccaagtgcacagtgtggaaagagggaaaagtcacttgacaggagagaaacctgacaaccaatatctcaaccaggtgtgatcaaggccaatggcaacagtcctaaatcatgttgatattatggacccttaacaggatgtgatgaaaatgacactccatgtctgtggtcttcctcctaataacccataaccccggttttatatagagaaaaatgtcaaatttctaaatcctacaaaatacacaactagtactcttcgaaactgtcaaggttatcaaaaacaaggaaagtctgagaaactgtcaaagcccaaagaagactaaagggacatgacaattaaatggaattaaatgttacaatgaaaattaaatgttgtatcctggatgaaatcttggaacagaaaaggaaattaggtaaaagctaaaggaatctaaataaactgtagactttacttacaataatgtatcagtgtggttcattagtggtaacaaatgtatcaccttaatataagacattgataatacgggaaactgtgtgtcgaggagtgggcaatgtggatactctgtactatcttcccaatttttctgtaaagttaaaactgttctcaaaaatagtctatcaaaaaaaaaatgaaaacataaaaatactaaaagaaaacatgggggatggagtggagttagcctttttaagactcaaatgcagaagcgatttgaagaaaaaattgatacatctgagtacataaaaataaaaatgacaacacacacagcataggcaatatcaaaagagagagagctacggatggggaaaaggaggcaatgactaactctggggaatccgaagaaaggaaatgtaaggaaatgtaatcatagcatatgttaattgggtcagctatgagtaatatgcacacagtcataataatataaacaatgaatagcaatttatctaaatagagaggtatagatatgttgcaggatggaggaaggagaaataataagtgtatttatgagagggtgtaagagtgcaaatacttatttcctacagcaagaaattaacaacaacaaaagccccaattgaaaaatcaagaacttatagtataagcaggttattccaaaataggagttaaataccagaagagacagctaaaacataagaaagaaaagaggctgtccctagggagtagaaattgaagtggggaggctggggcagggtctgctatttttctatatgattttaaaaaatgtattctagaggccgggtgtggtggctcatgcctgtaatcccagcactttgggaggccgaggcaggcggatcacctgaggtcaggagttcaagatcagcctggccaacagggtgaaaccccgtctctactgaaagtacaaaaattagctgggtttggtggcaggcgcctgtaattccagttactcaggaggctgaggcaagagaaatgcctgaatccgggaggcggaggctgcagtgaggatcacgccactacactccagcctaggtgacggtgagactccatctcaaaaaaaaaaagtattctatctataaaaataaaaataatgcaggccgggtgtggtggctcacccctgtaatcccagcactttgggaagccgaggcgggtggatcacctgaggtcaggagttcgagaccagcctggccaacatggtgaaaccccgtctctactaaaaatacaaaaattagccgggagtggtggccggggcctgtaatcccagctactcgggaggctgaggcaggagaatctcttgaacttgagagcagaggttgcaacgagccgagatcacatcattgcactccagcctgggcagcaagagcaaaactccatctcaaaataaaaaataaacataaaaaataaataaatgcaaagaaatcaaaacaagttaaaaaagggtaaagggccacccagaagtgatttctgtaggtgagctgccctgggattgcggtggaaggtctgggggcacaaggtagaagctcacagcggcttctccaactgtatgtcctctcacagcagaaatgctccaaggattgtcctctgcctagagaaatcccaacagcagccttggtcaaggacagtatttcagctgcttttgttttcttgctgcagcataaaccttccacagggccagaaatttactgagacaggatgaaggtttgggctatagattctcagatactgaaaatgtggtcgatggcatttcaggcctttcccgtgctctcatggtggcaggttaggcccctgcagctcagctacacaacaagaggaggtaatagatggagcaaaggaaagaagccagaagcggacaagcaaggctgggagtagtgaagacagttggtgggatgggtagaagctcgggaggctgggaactgagagggaagtggtggcctcagtgggagagccccatggggagagaatgaggcagactaaaatctaggcagccaaagcagcagaccccatatcctcacaaatgccacagggtctaccccacttattggtccatgcacattttcaggagcagacacagatgctcaaagtttgaacagtctagagaaatggctattccaagacagtagcaaaatctgcaaatggtgaaaagagagtggagacggcaaagatatgctgagagctagaaagattctgcctcttacagcaaagcttaacagccctcctcacctccccaatggcagacctccaaggtctggagtgtcactgggaaactgtctttgatcatcataaaatatcacactttgccctacttaatgctttttttttgccttgaacatttatttaacattaatagcactactccctcttttttaattttcctttttgtgtcattttgataaatgtcttttgtaaatacccaatgccatttaagaaggcccatctgagctttttatgatactgtgtaatgaaatttaacccattcacattttttatatttagtagtttggtgttgtttgtattatgttactttatgtaatttattatatacatttatcatattcctttatatttattttatatgtatacataaatctcttttttgtggtttcttcgtttagtccccatgtaatcactcttgctggactgattaagttttctgtgtttcttttattcactctactggtttagaagttctacattctatttctagtccatggagattactctttaactttaaagaaacatctcagaggccgggcgtggtggctcacgcctgtaatcccagcactttgggaggctgaggtgggtagatcacgaggtcagtagatcgagaccatcctggctaacacagtgaaaccctgtctctaataaaaatacaaaaaattagccaggtgtcatggcgggcgcctgtagtcccagctactcgggaggctgaggcaggagaatggtgtgtacccaggagatggagcttgcagtgagccaagatcgtgccactgcactccagcctgggtgacagagtgagactccatcaaaaaaaaaaaaagaaagaaagaaagaaaaaaacatctcaaaacctctgcagctgcttttttttttttgactgagtcttgctctgtcgccaggctggagtgaagtggcatgatctctgctcactgcaacctctgcctcccaggttcaagtgattctcctgcctcagcctctgagtagctgggactacaagcacgtgccaccatgcccagctaatttttgtatttttagaaatggagtttcctcatgttggccaggatggtctcgatctcttgaccttgtgatacactcgcttcagcctcccaaagtgctgggattacaggcgtgagccactgcaccggccacctctgcttctttaagagaccatcaaaggtcacacacattgagccacagcaggagacaaggccatgtttccattctgctattactcctctgaactcccagttcacctgggctgcagggcagcctgaggaaggaaagaagggaatcatcactgctatcaggctcctaaacatggagcctaagtcagttagacttaaacaggttgtctaagtcagtactcttgggttctccatggtaagaaccccatgagtcagcactgtttgagtaagtgacagtctctcacagtaacccattaacactccttctcctttgtgtctgcccatattttgggggtctttctgggcaggggggagattgagagggttcataagaaagagaaaagataatgattaaaaagtaaatgtagttagccaaaaaagtggaaacaacccaaatgtccatgaacagataaatgcagtaaacaaaatgtggttaatacaaatacaataaacaaaatgtatggttaatacaatgaaatattattgtcataaaaaggaataaagttggtcaggcgcaatagcacacatgcctgtaatcccagcactttgggaggctgagatgggcagatcgcttgagttccagaccagcccagacaacatggcgaaaccacatctctacaaaaaaaaatacaaaaattagctagatgtggtggtgctcacctgtggtctcagatactcaggaggctgaggtgggcagattgagcccgggagggcaaggctgcagtgaactgtgatcgtgtcactgcactccagcctgggtgacagagtgagaccctgtctcaaaaaactaacaaaaaggaataaagttctgacacatgctaccacatggatgaaccttgaagacatgatgcacaaaaggacaaaaggacatctgattccactgacatgaggtgcctaaaagagccaactgcacagagagaaagcagaatagaggttaccagggctgggggaggggaggaaggggaattattgcttaatgggtacagagtttctgtttcgggtgatgaaaaaattttggaaatagatagttggtgatggttgtgcaacattgtgaatatactcaatgccactcaattatatacttaaacgtggttaaaatggcacattttaggttttatatatttatcacagttttcttaaaaaaatgaatgtggagagtttttcagggtgggcttgtttccttctccatttagggggatggaagcctgagaaagttcctgctggaaatctgaaccttgatccctagtgctgactgaggaagcgctctctcctgggcctggcttccaaggagggggcttcctcggagtcctggcctccttctcctctgttccccaaactggctccagcctcccctggccccaggtcctgctccagctgttacctctcagcttccctcacccaggccctctctgcttgcccaagccaggcattttaaaaataagccaggcccggcacggtggctcacacttgtaatcccagcactttgggaggccgaggagggcggatcacctgaggtcaggagttcaagaccagcctgaccaacatggagaaaccccatctctactaaaaatacaaaattagccgggcgtggtggtgcgtgcctgtaatctcagctattcaggaggctgaggcaggagcaccgcttgaacccaggaggcagaggttgcagtgagccgagatcgcgccattgcactccagcctgggcaacaagagcaaaactccatctccaaataaataaataaataagccagtgcctctgaacttcctggcactagccccttctgttttctgtcccaggtgacagctctgtggctgctgttttgtcccctctactaagaagagctcactgtctgtgaaggggtctgctcctcctcacctgccctccaggacccaaggaaaattctgggccaggacagaacagtagaggagagggaggcagaggttaatgggggcaagctagaacctccatcacgtgggctcagacaatggagctgcaccacttcacacactgctgtgaggaccattaaaaccattagcgggacattagctctgctccaggaactgcagagagggaggcaagggaggtgcccacagtcctccagaggtgagccctgagcctctctgggcctcggcttcctctgggtgggagaaggagcacagttgtctctctgcttccacagctaatttctacaaggggcctgaaatcttccttccctgccccttccaagaagatggctcagtcctctgtgcaactaaatacaatttccattttatatctttttaagagtattcccaaataaaaaaactctttgatcagaccacactccactattttctgctcagtgtggccactttgatgacagctcttggggtctgtgtcttaggctggaggtgccgagagggtggagtctaacccccatagcggtgccttgtacattgaggacactataaatattgggtgcactgaaccagacttcaagaagaatctttcttctttctgtgaatcttgttattgaattttcatattatctaataccctctgcagagaaggactcattttctagcatattaatctgatacaactggcctacaagtaacatgattctgtccagccctcaagaaaatcccaccacctgcattttgatcaaagcaaagtgagggaaaatgttctccttatcttaccatttgtctcttggatacgtgatgttggaaataaacagattattgagattttttcttacccaaagttttcagatatagagctttgttcagcattaataaaatatttatcctggccgggcacagtggctcatgcctgtaatcccagcactttgggaggctaaggcaggtggatcatgaggtcaggagttcgagatcagcctggccaacagagtgaaccatgtctctactaaaaatacaaaaaaaaagtagccaggcctagtggcggcctcctgtaatcccagctactcgggaggtagaggcaggagaaatgctcgaacctgggaagtggaggttgcagtgagccgagatcgcaccactgcattccagccagggtgacggtgtgagactacatctcaaaataaataaataaaataaaataaaacaaaatatttatcctggttaccggttactttagaattggatttattttccatgtaacctgcattagaaatttgcaaacactacagatgtcctcttttggcattttgtggtcagagtgatgaaatgaaaccactctcaaagccttgtcttgggacatcggatttgacagcagccgaacctgtcctgcggctgtgtttggatggtggggagtcattcgcccaccctggcctgcctttgctgcacaggaaataagctagtaattcaagtatatgtatttttagttctaactcaagctgaagaatcaaagactgctgggtccttggcccttccttgatgctgcagataaataatctggtgagccatgtgatttcatcttgcgccacgtgcccagccataaaacagggataacggcactgcctaagaggctgaggccttgagagctcattgctttgcatggagtgctgaagactgacagatgaagggctctaggcatgaggcgggaggctgcttcacctgccaggtggtgaaaggcaggcctgaacttccatctcctgccgcactcagaagaagctggctacattcagaggcccccacctggaaactactaatgaagctgaggaagtcacatccagccccactgtaagcagaggccacctcgatcttggccctgccccagctggactcccagaacaccctggagacaaatgccctccacagtcctttcttcctttgggagctaccagagcctcaccagggcaattcctgcatctcaggtcatgaacttcggttcatcccctgatactcatcaggtgcttatgcacacaacactgtgctttcccccttttgcttcggcaacagaactcctcacattctctgctgcagccacaccagcccctcaaatctcttgaaggcttggtcctcccttgagccacaaggcctttgcataagctgttcccttggcctggaactctcttcccctcagattccactctcagctgaagctccctttctgaggcacagcttccctgacccctgcctcagtccaccctccaagcccaccctaagtacccccagtgccacgtgtccttctgcaccatggcaatgccccactgatcacttcctccattgtttatcactgcctgctgtgagctgggcatttgtgtgggatcctctggctggtgtctgtctcccctagatcagaagaaaatacagggatgccagccggaatctcagcactttgggaggcctaggcaggcagattgcttgagcccaggagttcgagaccagcctggccaacatgaggaaaccctgtctctacaaaaaatacaaaaaattagcaggtgtggtggcaggtgcctgtaaccccagctactcgggaggctgaggcaggagaatcacttgaacccaggaggcagaagctacagtgagccgagattgggccactgcactccagcctgggtggcagagtgagactctgcctcaaaaaaaaaaaaaaaaaaaaaaagaaaagaaagaaaatctaggggtactgctgtttctgtaaatcctcagagcctggctcacagaacagagctccataaatatttgtggaatgactgaatcctcgttaaagcacctaacccatagtcttaactcccctccttccattgacgcaagtgaagatacagttaggatttttaaccagatcaaatatctgatttgttagtgagagatcgcaacttgcacgacactgaccactactggttctagtggtgacctggatttagtgccattctgtatgaaacaaaaccagggggctgtgcttccggctgtttgtgcggttttgtgcttcattcttcatgggcacagatgagcacggtgataacagtgtttacgaagccaggtgccggagacagtgaggatggctacaggaaagaaaggccacagattgctcttcagtggcagtgagaggagacctaatgcagaggctgcacagtggtgctgggattctataaccaacaacaaaagcaacaccctcattaccgacactcctgcagctcaaactactttgcctttgtgcgttggaaacccaacccaagcccattttccccactggaattatttgtgatgatgtgaagtttttggagatgcaaccatcccagaacaggcacgctcagatgagaagacgtgggagacacagttctagcaaacagttctaccgctcagagcaaagcctacgtcacacagcctctagggtctgggcacagtgtggggacaggagggctggccgccctgcctcttgaaaggaatacgcagctctgcaggttcaagccacccagctgaagtcctcaaactgggtaacacgggccaagatgccacctgcacgtgtcctgctacatcaccatggatctggccaaggagccaccaccccctcggagcacgcatgctggggttgtcaaggagaccagtgcacaggacggccgcacccagggctggagaccggcagcgcaggacagctgcatccagggctggaagacagactcgagttctgacccatctttcaatgggagagaaagaatccaatcccctgctagggccacaaggacatgatgggtttggatgccataagagatgagaacactccaagctgaaggcaagaagtgattaccctggttttaggcagtggttggggggtggaggtggaggggaactcacctagtccttctttgaaagacagtcaggctacgtgctttgcaaagggttaggaggtggactgtgtgggaaggcaggcgagagggagtttcttttcatagcctgtttccatggtgtctcacggcccttggcaaaccccagctggggaggcttggacggccaggaggccccaggtccaccctccaaggactatcccctagtcctctgggccccaagagtgacagaggccacaggcaggcggctactctctcttgcctccctgggggaaggtggcaagaggccagcgataaagggcagagcagagaaagaacaactccaggggccagggctgcggctccctcccttccacgtcccctcctccccctcctcccacgagcccacccaaggggaaagttttctccctgaagacctgcagggctgtctgcacaggagaccctctcacgagaaacacattcttgcctcccgcctctccgcctggacaacccagataaccagataagggcctctttgatttcccgtgtgtttacacaagctgtggccccaagtcttggaaagaatcaaccaccgccaggcaagtcaggacgcctccaggtggggtgaggggagacggccgccttacctgctcctgggaattcatcactcgaagcttcatctgcttcaggtaggtggaggtgaggggcatgttgtaatcaataatcccagagaccagtggagatggaggctcgttttctggcagaaagaacaaaaggaaagccctttcagtctgtgctgcgggcctgttgcccacatggagcatttaacagagcccgtggaagaggaagccaccttggaggagaagggacaggtcagaggtcgcagactctgtggctcacccacatctggcccagagatgtggactgcatggtgtcaaaaatattttttttttattaaatgccagtgttctatttagagatttcacacgttaaaaaacaatgaggccgggcgtgctggctcatgcctgtaattccagcactttgggaggccaaggcaggaggatcccttgagccccaggaggggacacaggccccaggagttcgagaccagcctgggcaacacagggagatctcgtctttacaaataataaaataaattagccagacgtggtggtgtgtgcctgtagtcctagctacataggaggctgaagtgggaggatcgcttgaggccaggtggtcaaggctgcagtctgcagtgagctgtgatggcaccactgcactccagcctcagcaacagagtgagaatctatctctaaaaaacaaacaaaaaaacccagcaaacccacccccacaacacacacacacgtttataggaatttttggcttctttgaagaacataaggtctggccacatggggcccccactcccgaaggcaagcaaccactgccacttcagcagccacttcttttagacagggtgtgtggctcccattttgccacagtccccaccactccttatcatattgcacagctttgctcatttgcaagtatcaattatgatacttgccagacccttgaaggcatctgtgtttccaaccactgtctaagtcagttatcttccaggtgaacacatgccactctcacctcacccaatcccgccaccccatagcatcccccaaaaacatcctcaggtgccttatgcctcccaggtctgagccaggccttcagtagcccccaaattctggttcctccttcatcatatgcagaggaacattctcctcccatttattcctttgttgtcctgaagatcaaagtgatgcatgttctttttgcagagaatttgcaaagtacagaaagatgtaaagaaaaaatttaaaaaccataattgcaccacgcagcttggcatatgcttctgtttattttttccctgtgatttttcttttttacacatgatctcataatgcatacagagaattccagtctgcttttaaaaagtttttttttccttaacattttgtcataggtattttccccaacatcaagaatcttattttgctttgtaagtagaatttttatggccatgtaatattttaccataatttgcttaagtcattctctaacgattggctatttaggttgttcccattggggctattataaacaacactgcaggggacatctttgtgcataaatattgctccgtatttctgatcttatttcttgcctttttggaacagattacaagaaattaaaaggtagggacataatttgataaccattaaaatctctgaccaagctgctgtaggaattgtttcaattacttgttacctggcctcctcctccttcttccaaggacttcaggccagattcattttgccccagccttttaatcaaaaggtgcccctggtacatagtcccactgatgggctgggatttccatagcgtgaggaaaagtgggagcaacttccagaccaagtgccctctaccatcacaaggaggcccaagagacaggctgcagggtgacagggccgaggtccaggaggaccagaggatatccgggggtgacttataatacctgcccctcaagagccatagcccaaaagggtccctgcaaccttgaaaacgcgataccaagggcaagaagccagacataaaacgacaaccactgtatgattctacttacacgaaatacttagaataggcaaattcaaagagacagaaagtaactcgaggttactggggactggtggctgagggaatgggacgttattgcttaatgggtacagagtttctgtttagggtgatgaaaaagttttggaaatagatagtggtgatgattgctcaacagtgtgaatataatatctttaaaatggaacgattaagccgggcacggtggctcacgcatgtaatcccagcactttgggaggcagaggcaggaggactgcttgaccccaggagttcaaggccagcctgggaaacatagtgagtccctcgtctctactaaaaggtaaaaatgttagctgggtgtggtggcacgtgcctgaagtcccagctactcgggaggctgaggtgggaggatcacctgagcccaggacgttgaggcagcactgcgatccagcctgggtgacagagactgtgtctcaacaacaacaacagaaacaaacaaacaaaattattaaaaaggcaagtttttgtgctgtaaatgttttaccataatttaaaaaggaaaaaaagtctgccaacaagcggtgaagttacccaaagaggacaagggaagttcctgcttggcaaggataggaacagccctgcagaaaaggtggggacccggaatagctggggcctagaggatgggggtcctctttgacgctgtgtacttctggtgactttatagatcaaataacattttgaataaagttttacaggaatgcagaacttagttttgctctttaaagctaccctgtcacatatagaatgtttcattctttgttctttgaggaagaagtagacgtcggctgggtgtggtggctcacacctgtaatcccagcacttagggaggctgaggcaggcggatcacccgaggtcaggagttgggagaccagcctgaccaacatgacaaacccccactctcctaaaaattcaagaattagctgggcatggtggcgcatgcctgtaatcccagctacttcagaggctgaggcaggagaatcactggaacccgggaggtggaggttgcagtgagccaaggtcatgtcattgcactccagcctggtgacagagcaagactccgtcccaaggaaaaaaaaaaagtaaatgtcactaatggaatggctaagaaactggcctgaaaggaaccaccccctcctcctcctttttttaagagagacttctgcttggttgggtggcagggatcctctgcaccgataccaaactcaaatgggtttccaccccaccgtcaacctagatttgactttcttaacctcagtggggttttaaaccctagccccatacattgaccgggtcggatgccacatgtcaggcaggcagtctagtgatgacactgagatggtatcgctcagaagagccgtgggtcctgttttcagaggtggatgtttggactgagaattctgccatttctgtttcctctaagaggaggctgtctggtgagaagctgttaagcaccatggtgagtgtgacatcatggtgagtgtgaagggcgcccagcactctcgcggccccggtcggcccttcgttgggtgttgcagggattgtctaggtttgggaggcacggaggcggggagctgtgttcttctactgatggtcgcccctgtcctgactgcagtgtcatgactgttcatgagaaagtatctttaataaagctagtgacagtgtggcttaggaaaaataaaacagtggccaggacagcacccttgggaggcgtgagaagaggtcttccttggcctgttcccaccccagtgtctccagagatgagaaaccacttcccgtgcctgcaggtaagccaagagagctcagaagaggaaggcaggatgtcctggtcttggggaagctggaacatcccgagcagacccctaaacccatcggagaacaccttacattgctgtaaggtgaaatgcttgattttgcagttccagaatgagagttctgtgggggagggaggacctccgcagggaggggacattctaggtgaggaaatgagccatggagccatgggtgggaggtcagagctcaaccacaccagggtgaggagaaaagcaggcaagcttttcagcagtgaggagccccaggtgttctggattcaataagtgggtgcacactgagaggatgggcttagtgggaaagagacggagcaggggccagtggaagccgcagagtcagatgctcaccagtgagaaaaacgccaggatgggggacaaggtcaggtggaaacgtgaacaaggaagaagtgggttccttggactctgagacacgccgcccccctccctgcccatggtcaacatgtggtgccacactcgagcctctacaaatgacctgatagtgcggcaccgctggactctgttgccatggagaagggtgagctaggagctagcaagggtcacggagcctaaatcatccagcaggttgctggcaagagaagcacaacaagagcccagagagatctttcaacatctctttgccaagaaaaatggaaaccagcccaggcactagacctagttttatgcagtctcgagaataatcaatgatgtgggtgcttgggccaagccaggttgtttgctggcctgtgcagctgggcgccaatggcactcatcaaccaatgcaaacctcaaccatgggagtgaccctcatttcctcgtgggaacaccaggtggtgatgctcacaagctttcacctacagcacgaagaactctcagtccagagacaggtatgaaagatcttccaggcaggggtgggcgtcgaaggatgtgtgcacgatgggggcctggcacagagaggccgtgagaccagccagcctcagggggttcaaatttggaaacagagatcccaggcctgagaccagctcaaaaggtggcaaaaaaaaaaaaatctccttcctggggaagtaaatcattgaattggcaagtcttcgaggagtgctgatgtgcatgctatccgggtggggaacgtgaggaaactgtgtgcggtgcagtccccaggctcaggaaacaagggtgaaggatgagcagggtgcgacagacgtgaggccattagggtcactggaggaagagctgagagggccccggagtcgctcaaggaagcttcgtagagagaatcggaatgggactcacgaactattgctcagctgacagctccttagcacctgcttagggctccacacacacactctggttagaggctcccaggaaccttgtgaggtgggtgctcatagtaataccctgactttacagatgaggcaacagcacacagagaagctatgcaaccttcccacagtcccacagcaagcaagtgtgagagccgggagaggccaggctggcaaggagggatgtggaggggccaggcatggagggccttggaaaccacgcagaggagtctgggcctggttgtgaaggggtggagacccaagtggacaacctgcctactgaggaagagtcagcattgctgcccattggctactcccagtttgcaaccatgcaacaatattttgtcacatcaaagaaaacagagacatgcctccaaaggtccctttccccaagagctgggctggtctaaagtcacacccactttgcatgctgtgtcctcaattcctcagggactggtggaagaggagtgtggagtcaggaggtcctggaatttcccgtcctcagacttcctgatcctctgccacctcctttgtttatgctcctggcactgggggagggcacggggctgtccaggtcccccccactctgctggggagagaccgctgagcaaaggaggccactctacttcctttctttctttttaacataaggccaggaagccaggcattctcccagcagccctcaaggagcctccatcctgtcccctgtccccgctccctcccaccttcctggggcaggaacactgggtctgcctctggggctggtgcaggctctgctttcccagcagctggagagggagaagggagggctggcaatgcaggggtgcctgggagacagcaggctatagctgcatccagtggccagcatggcgggcagagataggatctgcaggctttcagcgggggcaggaggaggggaacctggggacggtccaggaggcgaatgcctctggccacttagcagacagtggagcctttcagactcaaaactctccactggcagcttccagaaaccaggcctttcccttctaaccctgtccagggtgtggacccagcatgcttgcctggcagggctgggggccacatctgaccctacctgggtagaggcagaccttgtgtctctgttgggccacctggacgttggcagccttgtgtctgggcaccgtaggccacgacacgggctggaggcaggaggcagggtgatgctccccaggcacccgctgcgtcccaggtgccctccacaataggctcaccctcaccaccctgaaaggatggcattccttccactttgctgatgagaaaatatggtttcctgcctgcacttctatctcctgggagagcttggatgtatgatttcacctcaacacctctctgtgcctcagtttccttacctgtaagccaggactaacacctcataggatctttgtaactgtcatgatcaggaactgctcagagaggttccctgtcctgccgagggacacacagtggggaacagggctgcacaccagacctgcctgactccaagtccatgcccttccatgagccacttccccgggctcctgctccctcagcgtcttctcctctccctgcgaggagaagctccgctacctgggacagagatggcattgtgtctgaggatgggggaggatgggtgagaatgggcatggtgctagtcttctgtccagcctgaagaaagccccaggaaagatgggcttcagcgctggtttatattctagatggctcctggcctgtgtgctccctcgctccctggcctctttctcctccctgggggtggggtgtggtggtggcagccagcgaggagaggaagcaggccactgctgtgctccgcgttgccctcctggccacacagaagcccacagatgaggagtgcagcctgcagcatggggagacctcgcagccatcagtgaggagtgcggagggagctgaggaatgccctccatactgccgtgggatgtgtggcaggagaggggagcggatggcgcctcagacaccccagagcagcccacaaatggagcccctcttggcttcgcctctgttcctccaggcaagcaattctgtgtctgactccgccagttgctatggaaacaatgaggaaaggaacgggaggggacaggcggatgggtgggcaggaaccaggcagtcaccactaggacacacacccctggcccctgcggcctaaaccctggcagggtggagagtggggcagggaaagccctccagcccatctgcaggtaccaaatgctgtcttggcccaggggttgcagctgctgcctggccaggggcagcccacgtgggtggcagcattcaggatcactggctcaggcatgcatcgagggagtgtccagcattataacaggaaccgcaacagccacagctctctcttcctgcaccaatgccaggtacagggactaacccatatcttgtcagccttctgattaaccccatttcacagatgagggaactgaggctcagaaagatgaagtcccttgcccaggacacacagcagctgaatggtagtgcagccctggagccctgttcttaacatgggaaccagcatttatgagggattaactagatccattcctgcccctcgtgctttgaagttggcccatgtgcccaatgaaacagccgtggcctgatggctcccaagggcatggaagcctctggatttggtgagtcagctgctgtcagaagccgttcacgtgtgtcagggacaatgaacacaagcagaaagccccgcttgacgcccatgctcccaatcctttgttgtctgctcaggctttgctgtggatttttccttccccagattcaatggatgctacttgagtgccacccggataaacggcgcgcccttcattcgagtctgtttccatcctcgggcctgacttcagcaacttccacaggcccgatgcccgggagctggcatgatgcaccaggcagtcctggaaaccctgataaatcgcccacctgggcaccatttctcagggcagcattataattgtaccagccaaatgtgctgggccgtctcaatgtgccaaagccacctgcaaacagatgggcccccagatttcctggaggcctctgggatgttcagtttgagggggtgcgggggtgctgaagtgaggtccttgctggtctcactgggcaggacagagctggagggcatggacgtcagtccaagggatcacctttggtggtcacaagtgctctgggcattttattttattgttttttgagatggggtctaactctgtcacccaggctggagtgcagtggcatgatcatggctcactgcagcttccacctcccgggctcaagcaatcctcccacctcagcctcccaaactgctgagattacaggcatgagccactgtgcccagcctgccctggtcattttaaattctcatcagtcggccgggtgcagattacacacctgtaatcccagcactttgggaggccaaggcgggtagatcatgaggtcaggagatcgagaccatcctggctaacatggtgaaaccccatctctactaaaaatacaaaaaaaattagccaggcgtggcggtgggcacctgaagtcccagctacccgggaggctgaggcagaagaatggcatgaacccgggaggcggagcttgcagtgagccgagatcgcaccactgcactccagcctgggcgacagagcgagactttgtctcaaaaaaaaaaaaaaaaattatcatcagtactccgtgggtttacttatcagaggccacatgggtgtgcacagggtggaaacaagcaccagggaagatgtatcattaacaggtatgtgggtgggaggatgcatgcacacgtctcagggagggtacaggccagaccctcgtgcatggagaagcagtgggaggcatggatggaactttgagaacggggcaggctggccattcccaactggaatccggctgggaggaaaggggctggccggggccttgcaaggcaggggaaacatgttgttcacttttttgttttgtatggttggtttttaagtgaaatttgagatttaaaaaaagttaaacgaaacaaaacaaggcgctttgggcagcaccacggacccatactggcctctgggactagcaacaacagctgctggacacttttctgtgccagcaaaagctggcgtcttcagggacagtccactcttagatggcccccgccctagccctccagcacgccacccctgctacctttgggttccaggccattggagttaaagtgcatcctcttctgacactccgtacagctcatcaggaaccgggtcacggcctctctcgggaggaaggcataggtctctgcgatctggaggagagaagagcttcgcttgttatatggatctgtggggaggcaacttggccatggggtcaccaaggtctgagctttggtggcaggtgcttcggctcttgcaaggaaagtcagggatttgaggagcaagggacaggtgtcctggattctcagctgtggcaatgagacagtacttttgtggaaaaccatttgttttaaaaatcgcaataaaggaggttaaaaattgaaaaagcaaaccctttaaacattatctagtctttaacctatattctaataagtaacattcctcagaacattttattgctgctacaaaaaaatgggcttacaaacattgctctagcgtagggtgagcagttcccctcttagagatggatagactgagacccacagataaattcactgccccaggcccatacacagaaccaaaggtcctacaagccatctcctgtgatcactgacaggtcaagaaccttcttaggaagagctgtgaagggctagtaccaggcatcagacttttcaaactagacaggctctgcaggacccccatgttccaggcaactatggcttggagaggtgagctgactccccaaggtcacaaggaattttcaaggcagtgccagactaaaccccatgttccaggtcacaccactccacagttgcctccagaaggcctcccctagttgaggaggaggacagggatgcagagggctgggggagagacacaaagaagggagggaacatgaaaaaagggctgggtgggggagtggggaagaagtggctgtgggcctaggtgtccagccctttcctcttgctctgggttttggaaaagccactgaccctgatttagctgtctggtggggccaaagagtcccttcagtcccaggttccctgggctgagactgcccagttactggttttccatgtgcttcctggagcctgggtcctcccgcacctctccactaaggggcagcatcacccaagcgttccgctgtcctcgccgcagcccgcagccgggctgggaaagttggccaagggtgaggggctgctctgcgctgcgcttggccccgccttcccacagcaactgcaggggtttgctcctttagaaatgcacgaatgtccttctccatctctgtgatggctggagggtagaggtgggctagggcggggctggggagtggagttgtggggggatgcagaaggcttggggtgtcccaggctgtggctgggctcttggaggaccagctcaggcacagcttccagctcagcccactggcagagtccaggggccactcttgccagctgcaaatgcgaagttaattttggtgacacaattgttatttctcagctgatttgatgctctgtggagcaggcaggctccttgatgagttatctcccttccaaattccctgtctgattgccttcctctggaggtcagggacaagggcaaaccccagtgtctctgactggagcagcggatgggagagcaacatcagggatgcagctggtccttgtcaggtgtcaggtccgagggatggggcttttctgccatgcacacagagagcttcatccctagcccaggccaggataaatgtggccaccactctacccctggagagggagccattcctgtgccctcagtaggccaggcagcaagaagggccctgcccatcctgtgtgcagccctcagcagagcagcccagggctgcctggaagtctgggggcacgttcctctcaggccagctgggtctggagagagatgtctggctgaagggtggcagctgcaggagcaagtgtgcaggagggaagggcgtgtgctaggcagagcagagggctgtggctgacttgggccgacagatgcccctcggctcccctgagacgtggcaccctaggtcaggcctcaggagagctcagtggagggcccgggggagggttgcacagtcagctgggagaagagggccaggtccctaccatgagggcagccctactaagctacccaaagcttgcctgctcacctgccaatgggcagagaaatattttttaaagggctcagggggtcctcctggcctggctgctctgctgagggctgcacacaggatgggcagggcccttcttgctgcctggccagctgagggaataggaatggctccctctccaggggtagagtggtggccacatttatcctggccttggcagggaccccagcagtgtgcaaaggctggctggcgtgccacagggaggggagtgctgagcacacaccttctggccctgggtcccattgatgggtggaaggggaggatagaaggctgacaggtgagaagtccttggaactgcctgagggccagggagggaagccctgccccacaaggctggattgtctgcaagcctggcttagagctccctggggagtcaataaagcgcagagtccagcccagctctgcactgccgtagggacctgtatagaggatgacaaaccctccccctgcaaccttcagcaggcatcttctgattcatcttcctggcttgcctgggaccagaaatgggacctccatttctgattgagtgcacgaatgcccaaggccacaggaccacagaatgagtcgaaaccaggaggacaatcctagcagatgctctagttaataggatggtggttttcagatggttttagatttaagctgcagaccctgttctagaaatagactcatacactgaagcccaaaacatgaaacagataaagacagagctgctgtgtctaaggaggggaagttccaggacccttgtccctgcccaactgccctccgctgccctgggctgcctgctgccttgctccccgggcctcctgcctggacactgagtcccgtatgtgaatttgcctttcacatttttcctggtggtaaaaaacagggacttcactggcagagagagcaggagctatttgcagagtcgctgacttgcaaggccccatttcactccccaactcagaggccaacaaagacagatgaggccaattggggggatttgcaccactttacaagatcctccttctgccctgagggtggattagcacgtggtgggcctggagcagctgctgaccacatctggccccaactccaaagtggcctgggcagctagatccggactgtggaacccgatctgacctaccagcaccctgggagggaaaaaggaagcaaaagggcttgttccaacccagaagggtgcagaaatcagaaaagcaggaaggccccttggaaaaaggactagccctctgtgtgagttcaggaaactctgtagaaccagctggagccttcctcaaaccctggtgctggagagacctccgagatcctctgcacctcaggtcacactgagaagctaagtgagacagggacttcctactcgaaatgggaatccctgcattatccattgcacatggccatctaactccagctcgaatacctccagtttcagaaagctcattgcctgccctatctgatccacgggtggacagcagtagatgccagaaagctcttttccctaccaaataacacgcctcatttagtgcactgaaaaagtctgccaccgccctgccagtcctaactcctatagtaccctcctaggcctggaaaaatccagaggggccctgtgccctagagactgtcaggcagtctgaggattcagcgttggcaaaacacagagatagatccaaaaagtcctcagccaggagcttgatgcgtaccccgtgatgccaggctgtgcccctctgcagccatcagcaggggtttccttgggggctccttccacaggcatggatgggtgggggcctcgtgtctgcagagtggggctgaagagctaggtatgggtcgaggaaaatgggagcagatgaagaggggcacaaaggcatccaggcaccaccccctgcccccaaaaaaggaaaagggtggcatgagaagggtgacagatggggaggagaaggggaaaaggagaggaggcacgtaggggaggagggaggtgtgccagccccttcggcctcacacccacggcaggagggccctggcctgctcagctcagccttggccctgctgctgaaattccagctctgtgtgcagctcagctggctcagtgccagtcatgtgccagctccaggctgggcagcgggaagtggggcacgcggcaggcatatggacgagaagccaggaagtgcagagcaaagggctggatgtccgcttggcccagggatgcaagtgctggcagaaccagctcagccctgccctccccacagcatggaggccgcagacccctgccttcctaaaccgcccaaagagtgcctgtggacgaggcttgatgctggacaccgaaggggccagggaaaccacatgatccagctggctccagcccatccgcctggacaacagcaagtcatagggcttactagctgaccacaggagggttgcagagaggcaggatgtgtggtggtcagggcacaggctctggggtgggtggcctggctctgaatgtcagctgactgacctcaggcaggttatgtgtttctctgagtctcagttttctcatcttaaaatggaggtaacaacagcacctgcttcatgcatgcaaccttcatacatgtgtaggaagtgctggtgtagagcacatgctgactgctcagcacaatggtgaattttatttatttctttttgagacagggtcttgctctgtcacccaggctggagtgcagtagtacaatcatagctcactgcagcctcaagcaatcctcctgcctcagcctcccaatcagctaggactacaggcacacaccactaggcctgaattttttaatatattttttatttttatttttggagacagagtctcactctgtcaccctggctgaagtgcagtggcatgatcccagctcactgcaacctctgtttcctgggctcaagtgattctcatgcctcagcctcccaagtagctgggattataggcatgcgccaccatgcccagctaatttttgtatttttaatagaggtagggttttgccatgttggccaggctggtctcacactcctggcttcaagtgatctgcctgtctcggcctcccaaagtgctgggattacaagcatgagccaccacgcctggccccaatttttttttttaagagaaggggtcttgctatggtgcccaggttggtcttgaacttccagctcaaacaatcctcccatctcaaccttccaaagcgctgggattataggtgtcaaccaccatgccccacccacaatggtaaatttaatgctgagaaaatgtggtcttgtcagtgccaaggggcccatgtgggccccagcctgggtgcctcttccttcttctatgatcctctggtggaaataccctcagaactcccttcccacaagtcacttcccaaagcacacagaccgagaagcaggaggggcggggagaccatcaccatctcctgccttcctgggcagacaccttgcctctctgaggctcttggcacatgggtccatccttaaaatccatttagggcaaaagccattttctgaggacaaggactaaccggatggttgcattaaaaaaaaaaaaaaaaagatgggccataaggggaaattatagactttacagccacctccacggtagtccaaagctatttatacaaagaacttggggtgggaagtttcacatctgccttgggtggggaagcccagccacagaagggcatatctctagaagctccagagaaagtcggcatggaggacactggctgactgcaactcagctgccgtctgaccttggacaagtgacccaattctctgggtcccagtttccttaactgtgaaatgggtcctcagtgcctcggtcacaggactgcatcaaggcttgaatgagcatgaagggcttggctttactggcttccctgggcactggacaaatggttcagagctatgtatgagctgtggataggcccacatgtgggtcagcaggagatggatcagaacacaggcaggcccctctgcagggtgaggaggggcctctggtctggccagtcccatctatttccacctccctggcatttgtgatgcttcctgcccctaggttgccttttttgcccttatgcctccccaaagcgtagaatgccagtacaggtgtcaccttctccacacagtcccccgggctcatctgtgtctggcggtgcctgtgctaaatgcccctgagcctgggttcttgctctctcaaagcgagccttggagacatttctgcttctcatgtatcttgtttttgctctcagcctccccaccccaaatccaattgtgatctcctggagggtggggagcaggtccttcgacttcccctggggaactcccagtcctgacttcacaggatgagctcacacataggaagagctcaggacaggcctggcatgcagtaaatgccatgccatgaaggcatttgctcctctgattattatctgtccccagcaccccagccccagaacaggctgcaaggggctgggggtggtgtcgggtgggagcaagtgaagcagaaacggggaagaggagggcgcctcctgccctcatccctctccttccctccctctcacccccttcaacctgcttttcctttgtgctcagaccacagattccctcccctcgccctgtgagccatctctggctgccgtgcccttgccctgtgcccccctagatccccaaaggccgtttcatcacgcctcagctccctgccccgccccccaagcccaacatgtgcggagcccgtggcctcctgccaaggcctggggctgccagtggaggcaaagagacagaaatctcaccgctcggtaggttttcttctgcccagcgtgcttgggggctttgcctggctccgctgagctctccacatgcatcgagtagatgatgtcaaagaaatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccgacagtgggtcttggggtggggaggggagggagcctaccgagggggctccctggagggggacgccagagtcagggtggctgcagctatgaaatctaccagcaacaatgggcagagaacggcgacaacgaaaatacaaattaaaaaaccaagaggctccatgttcacaatttcagacagattgtgccagactcgggcggggagctcttgaatcacacgctgtgccaagaccatcctggaagtctctggggaggggggagtgctaaatagatgcggccccatcaggagctcgccaattagcagtaacctttcactgtgggcctgggctggggtcccgggggaacagctccgatcacctgggtgactcctgcctccgccctggcctttctgaaaagcttttcgcggctgcctgccctccccactccagcagctgagcgccagcaacggcacccgggccctttgtgtgtggagatgtacagaataacaggcacgaggccacgaggaggtggcagggccgtgtgaacggggcggccgtgggccccgagcctcttatcaggctggctgagtggtgtcagctggcccgactaggtgtgccaggagcaagacgggtccttcaatagcaaacagctgtggggctgacgcctgccctcccctccagcaggaaagggggctgcagggaaaccacagggcaggaggctgggggtgaggccagggcccggaagggaacggactgctggggaactgctccgtgcaggcagtcctcacaagggagatacacagacccagagacactaggctgtcagccaccagctccttcaggggagtctgtggggacgttagggggctttgaagatcaagagcaagccatatggagggaatttgaggggaaaggaagcaggcttttctctaaaagtgcccaaaagacacatctccaagagaattcttccccaaaggaccccaactcaaggatgtcagcaacaagaggatgtgggcttcgcctgctccttctcagctctctccagcacttacaacagtgcctgacacatagtaggtagtcagtaaataatgactgaatgactgagtggtcataagtggcagctgggcagggtcacttggacacactctgccatggtttgaatacggccccatcatggaagtggccctgtgaccccgagcacttactgtgcttcgagcttcaggccctttatctgtaaaatggggataacagaagcccctttcccatgaagaactgagttgtgtgtgcagcacttggcactgagcctggagtacagggattgctagatattgttattaagaagtgctttgcagttcaccatgtttcccccaggtatgagagagccgaacaccggggcaaccctcggaggttgttagggtcaggacctgcctgaggtacagtggctggtggatggcacagatggcttcagaccttggactctgtagtccaagtagaatacaggccacactgggaggtgacgctcgctcacaacacgttctggcacagacaggtcttggtttcacccagtagctttctcgacacaccatgatggccgaacagcagtgtctcttcaccagcagcccattcaagagcagagagcagatggggggcaaagggcatctgggatgtggggtcccgagccccacagctagcgggcagtgtccctaagtggtaaccctgggaggtgacctcactggccccaacaaggccctcttgccagtggcttccttcctggtcagaacccatttcagtgggacgtctcagatagcacatatctctctctctctgtgtgtacaggagaagccacttgctggtccagcttcctcgctgtgagattatgggcaaacccttcaacctccccgagcttcatttatgagatgagctgtaaagttccatgacttttctgctcttaacctctctcaggaatcaattttacctcttttggggagtatcccaccccctccgacatctcaggccatctgtacgggctgatcaatgactaacttgttcactattgacccgtaaatgcccagcattacagggctcttcatatactgccatgacagggttgggatgggacaaatattatgataggtcagttagacttttaaaaaattttttactcagcaaagatatggatttgggatgtacagttataatacacttctaaccagaggttcacattggtgaaaataaacaaaatgaaccttaagaatgaatatagctggttttggctgggcgcggtggctcacgcctgtaatcccagcactttgggaggccaaggcgggtggatcatgaggtcaggagatcgagaccatcctggctaacatggtgaaaccctgtctctactaaaaatacaaaaaattagccgggcatggtggcgggagcctgtagtcccggctactcgggaggctgaggcagaagaatggtgtgaacccgggaggcagagcttgcagtgagccgagatcgcgccaccgcactccagcctgggcaacagagcgagattccatctcaaaaaaaaaaaaatgaatatagctgggtttctatttgttgatctgggcagtagttatagaagtgtgttcaatttattaagtcattaaatcttaacacttggccgggaatggtggctcatgactgtaatcccaacactttgggaggcccaggcagccagatcacctgaggtcgggagtttgagaccagcctgaccaacatggagaaaccccgtctctactaaaaatagaaaattagctgggtgtggtggtgcatgcctgtaatcccagctcctcaggaggctgaggcaggagaatcacttgaatccaggagacagaggttgcagtgagctgagatcacgccattgcactctagcctgggcaacaagagtgaaactccatctcaaaaaaaaaacaaaaacaaaaaccttaacatttataatctgtgtatttctgtatgtctgataaactttaatttaaaaaacagtttttaaaaaggatatcatgggggtagttccactgaatttttaaattcaggtaaaatacccatgcagaatgtaccatctttaccatttttaagtatagagtgaagtcagccacatttggatcacctgaatccagaggcatagctctagaggcttagctgcttaaaggccaatagacctccctgttcaaaattgtttcagaccagaacacagatatttctggaaaaggaaggagataaaattttgtgggaaggaatggagaaagaaagcaatctgatgaggagacaatattttatgtaggtgagatggaaatttccccctaaccagcttgtgggggccttaggtgggttactttatttctataccttttttttttttcttttttttgaaacacagtctcactctgccatcaggctggagtgctcactgcaacctctggctcctgggttcaaacgattctcctgcctcggcctcccaagtaactgggattaaaggcgcctgccaccacacctggctaatttttgtatttttaggagagatggcgtttcaccatgttggccaggctgatctgaaactcctgacctcaggtgatccatccacctcagcctcccaaagtgctgggattacatgtgtgagccactgtgcccggcctatttttatacctcttgaaagtcagtttccgcacctataaaatgggcctaaaaagtgctagttggatgttccaaggatcaagaatgtatgtcaggcatccagcacatacagacttggttaatgttcatctcttcccttggacccctctgagtctggacattttgtgtttaggaatctcctcttatctctggtccctctgacgcgtccagaggggacccatgacaaaatgtgtccccctcagtaacacccaccatcagaagagatgcacagtcttatttaattcctaaataatatgctaaggctcccacaaacttggaataagctttccaaaagtcaaagtgtaattgaccaacccagataaaaaagcaaaacgtactgtcccatgtggcctgtctcttcccagcctcccacctgccctcttaggttgactctggtaaacaacagctttgcacctggtccaatgtgaccataaaattaatcccagcaaaattattcagggaagcagttttcagttagttccttctttaaaaattgatcactttctcccttaatgttcaaatttgggtcctgtaatccacctatctctacagcaaagatttacataggaaaggagagggcctggagcgaccagaactcaaaccacgcaagggctgcagagccataccttgaactgtcctctggtgagctagggccacctggattccatgtgtgctacaccctaggggaagaacgccaggatgtctacgtggccttcaaggagaaccctgagaagacagcaacaaagggatccgacagtagtcacgtgccgcagacatctctgctatcccttgcatccatggaggtaataaccttcatgctaaatgctgcaggggaggcaggccttccctagctaaggatccagacagtgctgcaagggaagagctgctaataaaggaagcagaaagcaccttccctgtagacttgggaagcccctgccatcccccttctgcctggtacccaaattagcttcatctaatccattgccctaagcaaactggacagtgaattgacaaaggaagttcactttatctataggctggatcaagaagggacttggagtctcctgcctatcccagcttcctggaaacacctagcaggagtaatggaatggaaccctgtatcaccccatgggaagaaccacgaaaaacacacagtcacttgtgtaggatcaacctctggggccttcctgcatggagaagaacattgccatggtaacacacaccatcctttcgaaccatccaacccccaaacagcctgccagagccaggccaacagaatcagacatggcaatagttttaaaaatttatggagaagctgggcatggtggcgcatgcctgtagtctcagctactcaggatgctgagatgggaagaccacttgagcccaggggtttgagtctagcctgggcaacacagcaagacccatctctaaaacaaaaacaaaaacaaaaaaaacctacacatttatggagctacattcttggacatcaccagctcccttaacaccagcccatttgggttctaaatgaaaagctaggtggcaagtcattgacaaaatcaccaaatgtctacttaaatacatctgatatttcaaaatattacagcaatggtccttagaccagcagcattggcatcacctgggaacttgttagaaatgcacattttcaggttccaccttaaacctaccaaatctgatgtgctgggggttttaacaggcccccccagatgattctgatgcaagacagattttgagaactgctgatcagaatgtctccatgattgagccagggaggtaactgtaggaaaacaggtattgctcattaaatatagacatgctctgtgcttcctggcctaatatattaatattttcatttccgatgaaggccaattttcctaatggtgagaacaaaagaatcttattgggcaacattagtataaattcaacacatctgcccagagacttaatgtggattatggatagaaagagcaggaacgccctgcatcctgacatcagatttttaagtcctccctggcaaagttaataaatacttaagcagggcatcccttggcaggtcctttctggcttcctcgttttcctcagatggatctgaatgctcagcatgctaattcccaggctgcagacctaagagggggatcggcatgtcttaccaggccattagacaggctcctgccggggcgacctcagggagctcctgaatcggactgaatcttgcctgtctccccacatgagccaattaaatggacccctgcccctgatggtgaagtgaggtccagttgctaatggattgcagttctgtcatctccattagagcttcgaagtcacttgctggtaataagttacatacttatcaaggtgggatcacagttttaggccaccagggtgccatttagtgtgccaccatcactatattagtagagtgtgccttccagcaacgacgaggccatggttgagaggatgcggctaaatagcggagacatttctcaactgggtttctccgatggtagaagaaaaaaccacagagaaaggccttaggataggccttctggtgcatttcggatccagctcttgacaaggaataaaaatcaacgagattgctattggacgagaaagtcagccagtagagcccaccccaaaggaagcaaatctttggctaccacgtgggagggagcccaggacttcagggggctgattgcacaggcaaatgtgaggatgccgctccatcccatccaggccatcaaagtggctgagatcacagacaaaaattaccctgcatattaattactagcatgctcttcccaacttctgcaatcatgccattcctcctgtccccaaaacccagccttaataaattcagtcagggctgggtgcaatggctcacgcctctaatcccagcactttgggagacagaggtgggaggatcgcttgagctcaggagttcaagaccagcctgggcaatacggtgacccccactccccccaccccccgccgccaggaggtctctacagaaaatgcaaaaaacctagctgggcgtggcggcattcgactgtagtcccaggtactcaggaagctgaggtgggaggatcacttgagcctggggaggtgtaggctgcagtgagtcatgaccgtaccactaaactccagcctgggtgacacagtgagaccccatctcaaaaaaaaaaaaaaaaaagtcagccagaactggagttttagaagcttctggggggattcctgtaaagtctcatttcagctcctggtggggctgaaaaaagaagcaagggggaggagtcagtctcctgcaaaggggccccacagggaaaggaaggaggaggtggagaggaaattgaaaaccacactaaactaagagaacaaaaagaaaagaaaaccagaatgaagaccatcacccaaacacccagaaaccctctcttcagcatccccaagagaagctgtcataatttgtaaagggcaatcaggtgattgaagagagggtattgcttcactgggacaaaggcagtattttaatttctctcggttctgaatactacctactggggactggaaattgaaaaaaaaaaaaaaaccctccaaaataggaatttaccccagaattttaggacccaaagttccattgagcttcgtaggcctggatggggcagagggatgggaccacactctccccataaataaataaatacataaacaaggcgctgaggactcaatatagcacctgcctcttctccacccttgtgcacaatctccaactgttagcgcgtagctgccgccgccaccgccaccaccgagtcgcacctgccatctggaacaggcctcacatattccaagacctcctttctgcttcgctgaacctccatcttctttcaaatcacgctggggaccaaaacgcacaccccaggccacagagaaaggtgcctgggaccagcccctcaaacaacggcgctacatttgaggatgtcatctcctccaagcagctctgagtcttttttctctttcttttgggttttgttaactctgggatgtctggaatgggtgtagggggaaggaatgggaagagaaaggggcacagtgggccacagtgccccccagttagaaggagaggggctggggaaatgcagatccgaatgacaatgacttatgagggctggagggaggagtactgtccagcatccccggacggacaggccagggtctgggcctggctgcaggactctggcctggcgggggcagggagagggtccacaggagggtgctgtagaggtgaagtcacaggcctaaggacaacccagcccccaccccaggcaaggggctgtcctgcctgggcctcagtttccccctgtgtgagcagacaccataggcataatggctttcgccacctcataggaagtgtgtgggaacccaaatgatgcacaaacagcacccgccctagaagacacccattaaagagctctgtctgctactctggcgacccgcctcccggggcaccgcagcctaggacagggaatcgggagtcaccgaagggggggtcctaggcggaaggaggtagccctgagccagccaggccccgcgggcgggtccctctcgggccgaggaggcgccctgggcgcgctaacgagcggagagccccaggtgcgggccccacccagggccgggggaagaggtggggctggagggggaggggagtgggccgcgctaatgactgttgacagcgcgcgctggggccgagctggccgcgcgcgccgctgacagctgctcgggcggggggcaggggcgggggcgaggcggccgcgctctcttcacggcgcaggcgcgtgcgccccggcggggaggggcgggaaggcgcgcgcgcgccgggctgggttcggagggcctgctggagcggctcgcgcgggctcctcgcgggcaggcaggtaatgagagtaaccatggcaacccaccagaggaagtgtattctgcaggagacgttaatcccctctccccggagctgggacagcctgactttccattctcacacagtaattagataccagctgtcagtgcaggggggacggctccgcggctgcagcccggctgggagtgggggggggggggcgcaccaacggggcgggggggggacacgcaggaacgggggcgttaaagacacagggacgctcggctgcggcgggccagggcggctggcctccccctgtctccagcctctaggcgcgcgcccgctcacctggagaccgcgcccgcgcgggccccgcccaccccacgcgcacctgctgcgcgcgcgcccgccggcctcgcgtcccccttccggccccgccaaccggctcccggcgcacctgccctgccccgcccccccgggacgctgcccacctgtcctttgtgcagggcggtaccattcgatcttgccagctctccttcagggagcgcccgctatgtgccaggcgccgtgccaagcctgatctcccgtagtcctcacagaccctccgcggtcagtgcctctgctgctccccgcccaaggcgcagcggggtgtggccatttgcccagggtcacgcagacttgaaccccccatccccgtgcccatttaacaaccaagatactgcgcctcccaccgcgtccacatccacatctgctgtggctccggggcctcctaaccgtcctgggagacaaaacagtcacactggtggctggcgtcgcggtgcacctactgtgtgccaagcactcacggcctcgtttcactttcgcaacagcaacgagagatctgttgtcccagggtgaggaagcaaaggcacagaagagctgaagcgatttgcccacagtcacaaggtacagagtgacagagctggggttcaaatccagggagtcagaccccaggataccaactactgggctccattagtcccacccctggattcgtggtggctgaaatccagcacacacctcttcttcctttcctcagttcagcccacgcaggttctgtcccagcatcgtgagtagctgcctctcctagccatacctgagaaatcgaagaagtttctaggcctaaagccactgccacaacccgcgtttctttttttttttttttggagacggaatcttgctctgtagcccaggagggagtgcaatggcaccatctcggctcactgcaacctccggctcctgggttcaagcgattctcctgctacagcctcccgagtagctgggattacagacacacaccaccatgcctggctaatttttgcagttttaatagagacagggtttccctatgttggccaggctggtctcgaactcctggcctcaagtgatcccactgcctcggcctccaaaagtgctgggatgacaggcatgagccaccacacccagcccacaaccctcatttctgtcaggcctcccaaaagctcctactgtcagtgcaggcagctgcttggaagtcattctaggccaccccttccatttcccaggtaggtgaaccaagaccattcaggtgcgaggctggcctgagtcagagatggcctgggagagcctttggggggcagggagggttcagtcccctcaggcctggctgtgtcccctgccccccacccacaatcaggcccagggttggggggtgcacaccaaggaggggcaggaagtgtccaagaagcagaaccggctctgtgtccccagtggcggcgggtgtctggggcaggaggaggctatctgatcccttccccactgccccggccatgacctcctccctccctccctcgctccctccctccctccctccctccctccctccctccctcctccttcatggctggggtagccagcaccctgggctgcagctgagaacccagcgttccccaaccccgccagcattccagtgagaggaggggtggggggagactgcacccagagctttagggacaggggcacccctggggctgctccactctgggagggccaaggccaggctgcctccaacctcaccgtttcctgcctccgctctccccatctctcagtagcagagctgcctaaatttggctccaggagggaatgggggaggcagcggcaggcgggtgccgtcagaggccagggcgtcgctcccgtctagccggctggcatttttgctgtctggaggagggcaggggggcccggcagccctctcccggaaagggagatgttcgtaccttctgacatacactgagtaatgtgcaaacgacatgcaaaccgagcttcaaatcagcatctcagccagggaacagcttgagagctgcttttgggatgagagcagaaggaccagagcccagtgcccaggggctccagtgggggtggggtggggtggggggcggcacagagtgtctagggctgggcgttgggagactcagtttcttgccagctgcagggctttgttccagtggctggaccctctgggtcccagcccaagggcagggccatggctttctctgcctgctccagcaaagcactgggcacaccctgtcacgtggttaagcacgtgagttctgcagccatcctgcctaggtttgaaccctggctctccatgggccagctgagtgaattcctcaatcgagcacccaggcaagcagctagtggaactgggtgtctgttttagaacagccacttcccttccctggaagttgggcacgggggcatgacgtgagagaacctgggctttggaatcagaactggattccaggcctcactcagccagtgaggctctctgagtctcactcccctcatttgggaaatgggttcaggatctcaaggtcagctgtgacgtccacgtgatgaccttgcacatggtgggcacacacaggccttcccatggtgcagcctcactgctgtctgcattcatgtgactcctagctccatcctgtcccatcgctcctcttctctttgttcttctgtcctggctttttcgtctctagatgtaaatttcttgcggtctttttcccttctgtctctcttcttaactggtgatcttggaaaagtcattgcctctcagagtctcagtctgcatatcttctaaatgggagtaaatgagaggtggacaatgagctctgtctggggcctgaggctcatctttacaagaccgcccacccatcattccaaagggccaccaggggtaggctgtgccctcaactctatcgggcatggtgtgttgggggctccacttctcagtaactctgtttaaccccagataactgctctcctgcccctcggccggggctgatatgagctgaatccagcttcctgccacccaaaagccacttcctgccaagctgataccagaagaacttgttttctgtgcacagagcagtctctggtggggcagccaccagcttgcctcgggtgtgaacatttttttccatttgccggtctgtctgctgggctgggcaggggaggctggggactctgaccccttcgcctctgcacgtgcctgtcctgccctgaggtagcctctgggcccaccagccatcccaggaagggtgccaagtgtcctctgggcccagacagatgtgtgtaggccgtgacacacagtctgacacagccacacacacacagtcagtctgacagagccactgtggccactgggcatttgggcaaggactcagggagacaatgtgtgactgtcacacacagttaaggtcacagagacatggacatagcctcacacatgcaaccatctgcagtccttggacagtctcacacacaattacacgcaggcccacagccatgctcagaatcccacagcactccacacagcttcacacatgtacacgggaatcttcctccccggcccccacacctgcccagcaccgaccttccagatgcattcactgattcaacaaatcctttttgagggtcttctctgtggaggccctgggctaacccataatcagaatgactggaacaggaacaaataattagctgccctgtgctgttgcctccgtttccccatctgtgagatggggatcctagccctgccacatgggactgtcaatgttaggagtgaatgtgtggaaagccctcggtccgtgtttggcccacagtgtcatctaagtaaggctatcctggttagccaaaagcatcccatgcccagctccacgcagaacacctggcacacattatctccctgagcccttgtccaagtccccagcagctggggtcatcgcccccattcctcagatgaggaaaccgaggctcagagaagaggcccacagtctgtaggttgccccaccgatctcatgtcatgccacagtgctgctccagcctgcctcgccaccccctacacacacacacacacacacacacacacacacacacacactattccctctggctagaaggcccttctcacttgcatatagcatgcccagctcctctgagctgcctacttacacttctgtgaaatggggatactagcccgtgtcagcccctgtttattttccccagggcactggactttaagggccaagagtgaagaccattttgtcctgttctctggcacacagtaggcactcgacaactatttcaaaactaaaggaataagcaagtggcctcatggctactgaggacagagtctggaactgaatgcagggcactctgaagctggagctcacttctacattattgcctttctcatgctactagcaggcactgaatgtgtcagtgagtgaatgaatgaaaccaagatctcaggatcccagtcaagtgctccctgagtttcatttcctggtagtgtggacatgagccaagctccagccaccttggatggtggtgggggtggcggggctgatgggccgcctgaagccggctgtcaggagctcgtctggccacagccgccagcaggagagaccagctggcggtgcagggtccatcggcccgggcctggaatctgagctgccctcagaggcccagcttctctctgggcccccacaaactggcctttgttcctgggccggccaagacccagcagcttgggctttctgtctgcccgcggcacccgcgctgagctggcggggtaaatgggccagcctcccctctgtccatgcccaggacgtcgctttaggactaaatggagatgtaattttctatacaaatccatgacaatttagatggagtgattgtaattggcttttcaatgggggttttgtccagagctggtggctagaactgggtggcctgtttgaggcaggctccatttaaatgacaataaagcaataatattgaggacttgtacagtgcccagcactcctcccagcccaagtagagcctcatgtttatggatctggtccttccctgaggctgtctggacaggcgggtggtggggggcgctaagcccaggagacaggtggccatatctttgggcttcaggacacagagcttcagaatggctggggcaaggtcccgcatccactggcttacctgtgtccttattcctgaaactgtcactaactagtgcctcctcgggctagctgctagtccaggtttcgggggcaccaagacaatgagagctgctcaggcaggtcagagggagaaggctacaatggccagtacagcatgacatttgagagcatgaccaagagatgaccaacagccagacagcctgagctcaaatcctactccacttctttttaaaaaaattttttttgagacagggtctcgctgtgtcacccagactggagtatagtggcaggatcacggctcactgcagcctcgacctccaaggcttaagcaatcctcccacctcagcctcccaagtaactggaccataggcatgtgtcactacacctggctaatctttttatttttttgcagagacagagtctcattgtgttgcccacgctggtctcgaactactgggctcaagagatcctcccgcctcagcctctgaaagtgctgggattacaggtgtgagccactgtgctcagcccctactctacttctgactcgtctcttgaaccttaccaagttacttaacctctccatgcctcagtttccccagccataacatgaagctgcagtgaaagtttttgtgaagatgaaacaccttaatagtgcctggcatgtggaaggtgctatatataagtcattgccgtgattcattccaagctctagctctggtgtcagggtgaccttgggcacgtgacttaacctctttaaacctccactggctcctctttaaagtggggcttttaggagaaccgacctcacggggttgtgaggattttagaggatgcaggaaagcgctgagcacacagccgttctcgataaacacgagctctcttgctgtggtgctcttgccttgaggagctcgccagctagtgatcattaccatgtcgagtgtggggaaaagggaaaagaataaagctcgcgggaagccaccacggagctcagctggctctgccatcaggggatgcaataggagagaatgatccagagggccctcaggaacagggcaaggagtggggctgcgtgaaggaaggcttcacagaggaggtgacatttgggctgggtcttgaaggatgcgtggcacttctgccaccagaaagggtgatacccagcctggccaacatggtgaaaccccgtgtctactaaaaatgcaaaaattagctggggctgggcacggtggctcatgcctgtaatcccagtactttgggaggcccaggtgggtggatcactgaagtcaggagttcgagaccagcctgaccaatatggtgaaaccctgtctctactaaaaatacaaaaattagctgggtgtggttgtgggcacctgtaatctcagcaactagggaggctgaggcaggagaatcgcttgaacccaggaggaggaggttgcagcgagctgagatcgtgccattgcactctagcctgaatgacagagcgagactctgtcacaaaaaaaaaaagaaaaaaaagattaactgggtgtggtggtgcacacctgtagtcccagcttcttgggaggctgaggcacaataaccacttgaacccaggaggtggaggttgcagtgagccgagatctcgccacggcactccagcctggatgacagagggagaccttgtctcagaaaaaaacaaaaaaaaaaagataccagggtcaggcactgtggttacaaagtcaacaggcagacctggctgcctcctgaatgagtgatttgtgcctgtgaaaagggtggtggacagggagcctctgctgaaggtgcgatgttaagtcacctctgaaggccaacagcctgtgcaaaggtcttcaggcaggcaggcggccggcatcgtgggcagtggtgtgtaggatggtggggaggctatgctgaacgtgctggagggacggatggggtggcggctgtattcacgtgaaacaggcagccatagagggattttaagcaggcgggtgacaccatccagaggatatttttaaatgatccctctgactgctcgtggaaaatgggctatggagaagaaggggtgagagagaggcagggaagccatggggaggcagttggatcactgggggagagaagtggttagacccaaggtatagcagggcccaggagctgctggaaggatgatgggaaggcagggggcgggtggagaaaggaagggggaaggggtacaaagaggcatggggcctttgaggcgtggtgaggggctgtgtgcagctggtacctgagcagggttggtggaaggagatagcagaagagaggtgagggccacctcccacctccctgcgccaggctaaggctctccagctttgtcctgaaggcagtggggtgccaacaaggatttttctccaggcaggaaaagaccatgctgagatttgtgcttttgaaggatcattttggctgcagggtaaaggggtgggaggtggcaggtgggcgaggctggaaggagagaggcagggagggagggtggtcagtggcggctcagaggcctcagcaggcatcctggccagctcccaactccaagagcaacaaaccactttctcagaggtctaaaaccagccccaggtcacacggcttgtcaatggcagagatagatcccaccccagggtgaactcaaaatccagtgcactgttcccctttgctatcaacagccttggtcactagtaaaatccatcacaaatagcttttcatcacgactctcagagaacccatactatgacacgaaaaggtgagtactattattattcctattttacagatcaggaaactgaggctaagtcacctgcctaaaagcacacagctgggaattgacagccaggttcagatctaggcagtgtgactccagacccacaccacaggtcctaagcaggaggtctcaggccaagtggggtctatggatgtatctgggggaacctacagaggtttattacaatttgagtttgttgctgatacttaaaagttggggctgggcatggtggtgcctgcctgtagtcccagctacccaggaggctgaagcaggaggattgcttgagcccaggagtttgaggctgcagtgagttataatagtgccactacactccagcctgggtgacagagcatgaccctgtctctaaagaataaaaatttttaaaaaatgggacatttcatgaaagaagaaaaacatgaactttggacaggacctcctaatgttgacaaccccaagccccagtccttgaacttcgtccaccttggggccactcacacgtgtgcgatgtcacgttgacatctccagcatgggcctctcctctgctgccggacagccgactggactgaaagcaagtgtgtgtctagggccccctggagagccagggcgacacatccatccactcatccagcaagcatttagacccccttcccccgacccgcccacagccctggccaccaccaccaaacttcctcccccagcaggcttctccatctcccttgcttaggccaaacaccctgaaggcatccttgactgctcactggttctcacagcccacatcccatccatcagcaagttctgttggctccacctttaaactatatccagaatgcagctgcattctccgctgtcccaggggctggaggtgcagggagaggcatgtgccgttattctagcgtgctgagtctcagttccattgtctgtaagaagggcgggctagagcaggatatttggattgccattattcttgtgtccagattttggagctaggaagagcctgtttacaagacacttaggttgtaattctttttttttctttcttttctttttttttttttttggagacagagtcttgctctgtcgcccaggctggaatgcagtggcatgatcttggctcactgcaacctccgcctccttggttcaggcgattctcctgcctcagcctcccagtagctgggattacaggcaggcaccaccatgcccggctaatttttgtatttttagtagagacggggtttcaccatgctggccaggctggtcttgaacacctgacctcatgacctgccggccttggcctcccaaagtgctgggattacaggcgtgagccagtgcgcccagcttttttttcctttttttggcgaggggatggagttttgctcgttactcaggctggagtgcaatggcgcgatctcagctcaccacaacctccgcctcctaggttcaagtgattctcctttctcagcctccttttacagtcatgcaccacgacgcccagctaattttgtatttttagtagagacagggtttctccatgtttttatttatttattttttgagatggagtttcattcttgttgcctaggctggaatgcaatggcatgatctcagctcacagcaacctccagctcctaggttcaagcaattctcctgcctcagcctcccaaggggattacaggcatttgccaccatccctggctaattttgtatttttagtagagacagagtttctccatgatcaggctggtctcaaactcccgaactcaggtgatccacccggctcagcctcccaaagtgctgggattacaggtgtgagccactgcgcccggcaaggctgtaattctaattcccttctggcctgggcaagacataggtgggacacaggagagagcatgggtgttggaggcaatggcagtcttgactttcaactccttgggtcaggagctccctgtgatggaggctgtcttgttcaccactgcatccccagtatctgccagagctgaccacaaagtaggtgcccaggaaacgtgtactgaaagaataagtgatgaatgagtcctcctggtcctccagagggaccttgggcattcactaactttcagaggggcttgattttcccatctgagaaacaggcaggacaatctgatgccactgccttccttctctgtaacaacaaacatttaccatgtgcttactgtgtgcctcaccctgctctaagtgctttacatatatcaactcactgactcttcactccagccccaggaggttgggacaactctcttttatgggggagaaaactgcggcccagagaagaaagtgacacacatgcccaatgtcacacagcacaaagcacctgagctagagaccagcccgggcagcctggccccagaactctcattcttttttgagagaggatcccattctgtcacccaggccagagggaagtggctcaatcatgactcactgcagcctcaaccttccacgctcaagggatcctcccacctcagcctcccaagtagctggactacaggcacaagccaccatgcccagctaatttttgtatttttttgtacagacaggttttcaccatgttgcccaggctggtcttgaactcctgggctcaagtcattctcccacctcagactcccatagttcagggattacaggcatgagccaccatgcctggctttctcattcttaaacactgtcctaggctgtccctcagtaagaaaggaggtttgggaagcctgccccaaggaagcacccaagttgcaggtggggacatgctgggcaggactgcaagctcaacaatccttctgtggctctgtactgcctgtcaaatgccatcccaaaactcatgcctggatttgaggcccctggaagcagctccagccatgtctcctcctcccagaggtcccagcacaaacctgacattccagcctccctggctgcttctcctcccatgagctctggggcaatcgtgcctctgtgcctggacacacactgtcccctctgcccacaactgggtgcccacaactgggtggtttcattcaaatgtcctctctctccccaggaatccttccctgaccttcccccaacccccaacccaacatgtctcttgccttcaatttcctgtaacactttgccaacaaggacaataatagccaatgtgtattaaacactcctgatgtaccagtaggtactattgtcaataccgttttacagatgaggaaacttaggcactgagaggagaagcaagttgcccaaagacaggtgggatggagtcaggattgaacctacatttgcctgacaaattgcaaagctagacctctaagcccctaaaccagaccacatctcactggcaggcatacaacagatgctcattcaagattccctagtaactgactgccttgggcttccacacttaattgccttttgcacacttaagtatgatctcagagattctccaggcatcacctgctgaatttgcatttttctggtagttatttcagaagtgggcggagacactctcaaggcatgggggccaaatcaaatggtgaaaaataaacaggatcagaagtcggatagatcatgtgaactgagatctctgtaaagtggggattttaattctgatcttcagggtcattacgaggggatgcacagtgccagcatacactgaatgctcaatatacagtaacctcggtcatcacacgaatggctcacgttctagacattattgccgggagtgaaaattggttccctgtctgtggagggcagtctgtatcatctccaaaagcacatgccctcagacgcagcaattcaactccttggtataaactcgcccatgcttgaaatggccatccatattcagggatgttcactgaagtcttgcgagagcagaatatcataaacaatccaaatgtccattaacaggggactggataagtaaattatggtacatccataaaattgaatactacacagctgtaaaaaagaaggagaaagttctttatgttctaacatacttatgcactgacagcatacagatttactgtttagtgggaaaaacaacctgaagaatgtaagagctaaaactataaaactcttagaagaaaacacagggataaatctttgtgaccccggattaggcaatgacttcttagatatgacaccaaaagttcaagcaacagaagaaaaattagacaaattgcacttaattaaaattaaaaacattaatgctacaatggacaccatcaagaaagcaaaaagacaactcacagactggggtaaaatatttgcaaaccatgtatctgataagggacttgtatctagaatacagaaaagattcttaaaactcaatggtaaaatgacaagtaatacaatttttttaacgggcaaggatctgaatagatatttcttcaatagagatatacaaatggccaataagcacatgaaaagatactcaacatcatcggccatcagggaaatgcaaatcaaaaccatggtgagatgtcacttcacacccactaggatggctctaatcaaaaagacagccaataacaagttctggccaggcatggtggctcatgcctgtgatcctagcactttgagaggccgaggcaggtgggcaacttgaggtcaggagttcaagaccagcctggccaacatggtgaaaccctgtctctactaaaaatacaaaaattagccgggagtgattgcccgctactgtaatcccagctactcaggaggctgaggcaggagaatcacttgaaccagggaggcagagattgcagtgagccgagatcgcgccattgcactctagcctggcgacagagcaagactcagtctcaaaaataaataaataaataaataacaagttttggcaaaaatgtagagaaattgcaaccctcatgcactgctggtgggaatgtaaaatgatgtactgatttggaaaacaggtagttcctcaaaaggttaaacatagagttaccatatgacttaccactcctacatggaagagaataaaaagcagaggtgaacacaaaaacttgtacatgactgttcatagcaacatgattcaaaatagccaaaatgtggaaacaacacaaatgtccatcaactgttgaataaataaataacatgtggtatgtccattcaatggaatattatcagcaataaaaaggaatgaagtacagtcaggtgtcaatgatgggacaggttctgagaaatgcatcattaggtgattgcatcgttgtgcgaacatcatagagtgtatctacacaatcctagatgacacagcctattattgtactgaatactgtagactattgtaacacaatgatatttgattttttgtttttttgaggcagagtctcactctgtcgcccaggctggagtgcaatggtgcgatctcagctcactgcaacctctgcctcccaggttcaagcgattctccggcctcggcctcccgagtagctgggccactgcacccggccaatatttgtatatctaaacatatctaagcatacaaaaggtacagtaaacaataatacagtattataggtcaggcgtggtggctcacgcctataatctcagaactttgggagggcgaggcgagctgatcacttgaggtcaggagttcaagaccagcctggtcaacatggtgaaacttcgtctctactaaaaatacaaaaaagtggccgggcgcagtggctcacgcctataatcccaacactttgggaggctgaggtgggcagatcatgaggtcaggagttggagaccagactgaccatcatggtgaaaccccgtctctactaaaaatacaaaaattagccaggtgtggtggcgtgtgcctgtaatcccagctactcaggaggctgaggcaggagaatcgcttgaacccaggaggcagaggttgcagtgagccaagatcatgccaccactgcactccagcctgggcgacagggtgagactccatctcaaaaaaaagaaaaaaaaatacaaaaaagttaggcgtggtggtgggtgcctgtaatcccagctactcgggaggctgagacagaagaattacttgaacacaggatgcagaggttgcagtgagaccagattgtgccactgcactctagcctgggagacagagcaagactccatctcaaaaaataataataataatacagtattataataatttaggctaggcacggtggctcatgcctgtaatctcggcactttgggaggccaaggtaggtggatcacctgcggtcacgagttcgagaccagcctggccaacatagtgaaaccccatttctactaaaaatacaaaaattagccgggcgtgatggtgggtgcctatagtcccagctactttggaggccaaggctggagaatcacttgaacccaggaggcggaggttgcagtgagccaagatcatgccactgcactccagcctggacgacagcgtgagactcggtctcaaaatcatcatcatcatcatcatcatcatcatcatcatcgtgagcatcatcctcatctcatgggaccactgtcatatatgtggtccattgttgaccaaaatgtctttaagtggtgcatgactgtactgatacatgctacaacatggatgaaccccgaaaacgtaagtaaaagaaatccattacaaaagaccacgtattgtatgattccacttataggaaatgtccagaaaaggccaatctaaagagacagaaagcacagtagtggttgtctccctacctgggggagggggtcaagaggaaatgaggagtgaggggtatggggggtttctggggatgacgcaaatgttctaaaattgattgtggcaatggttgcacatctctgaatatatgatactgaaagtcacttaactgtatttattattttttttttagggacaaggtctcactctgtttcccaggctggaatgcagtggtgtaatcataactccctgcagccttgaactcctgggctcaagtgatcctcccacctcagcctccagagtagctggggctgtgggtacacaccaccatgcccagctaattttttaaatgttttgtagagacagggtctggctatattgcacaggctggtcttgaactcctgggctcaagtgatcctcctgccttcgcctcccaaagtgctagattacaggtatgagctactatgctcagcctgaatcatattttaaatgggtgaattgtgtggcatgtgaattatatctcaaaaaaatgctattatattaaaaaaagcaacctatggaacaatgtacaacatattttgtgtaaaactagaaacaaaacccagaaatagatatgcatatgtgcatatatatgtataaaatatctctgaaaggatacccaagaaataacagtgatttcgcccggggagaggaacagggtgactggcaggcagggccagaaaggggactttttctttttaacagtctacgggtacttgattaatttttttttttttaataatgaaattctggcagtgcgcggtagctcatgcctataatcccaacactttgggaggccaaggcgggcggatgacctgaggtcaggggttcaagaccagcctagccaacatggcgaaactctgtctctactaaaagtacaacaattagccaggcatggtggtggacgcctgtaatcccagctacttgggaggctgaggcaggagaatcacttgaacctgggaggcggaggttgcagtgagccaagatcatgccactgcactccagcctgggcgacaagagagagactccgtctcaaaacaaaacaaaacaaaacaacacctttttctggctgggcacagtggctcacgcctgtaatcccagcactttgggaggccaagacgggcagattgcctgaggtcaggagttcgagaccagcctggccaacatggtgaaacccagtctctactgaaatatacaaaaattagccgggcatggtggcgcatgcctgtaatcccaactacttgggaggctgaggcaggggaatcgcttgaatctgggggcggaggctgcaggaagctaagattactcactggccctcagccagaggatgagcttggttggtggctctgagagcataggagatcccctgaggaatcctactttacagtgtgccaagcctgctcacaaccgtcctcagattcctcacacaggccctgccagaaggtttcagcaccgccccatttccaccagcaaatcctgtggcgcgcccttcaaaacaggcctagaatcggctcacttctcaccccaccatgggcaccattctggtccaggccaccagcctttctccctggttcacctggatcactgcagcagcctcctcccagcttccaccctcacccccaaccccagtctgtaacccacacagatctgtgctcacctctcaccactcacccccacacccagggctccagcccactccactggccttctcctggcgctactcaccaggcacttcctgccgcagggcctttgcacttgtccttttctcttcctggaatcctctcccaccagatccccacatggatgttctctcacctccagtgggtctctgctcccatgtctccttgggaacaggaggcctccccacacctatctcaagcagcagcccccagccctagccccattctctgctttatttttctatatatttaacatttacatttagggttcatggtctgtctccccacccccaaacatacaggctccgtggaagatgggattctgtttctttctctagcaccaagaacagatcaatgcacgttgtaggtgctcagaaatatttgtcaaaataaaactgggtcttatgaaactgtcacagaccagaggaggttaaggagacatgacagctaaatgtaacgtagtattgtggttggatcctgggacagaaaatttacattagggaaaaactagtgaaataaaaagaagtatgagttaatagtgacgtgcctggatgggttccttagtaacatcaaatgttaaccacaggggaaagtgggtaaggagtagacaggaactctctggactatctttgcaactttgtaactgtaaatctaaactgaccctacaataaaccatttgctgaaatgttaagaatgtattggatgtggccaggcgcggtggctcacacctgtaatcccagcactttgggaggccaaggcgggcggatc

SEQ ID NO: 578 - DNA, 590 bp, Homo sapiens
ctttatctttgatatttcctatttttaaaaaaacttatctgtgaattgatttaatgattgtgtatataaatctgccaaaattatttcaatggatgaaacaatgaatcagtacctatttatatgctgccaaggcacacctataattttttaaatgatgataagagtagcctaaagcagtgagcagacatctcagaaatttcagtgtaagtggttttaacttgcaacatgatgccaaaaaacttagaacagggagctgccatcttgcatccccgtgtgtgtgcacctaatctcagctggttccccccagaccccctgagcaccaaccctagtcccccgcgcagccccttatccgctgcgacaagatgaaagaaacaatcatgaaccaggaaaaactcgccaaactgcaggcaaaagtgcccattggtggaactgctcacagaaagaaggtggttcacagaacagccacagcaaatgataaaaaacgtcagttctccttaaagaagttagaaatctctggcattgaagaggtgaatatgtttacaaaccaagcaacagtgatccgttgacctgcaggtgacctcgaggggggg

SEQ ID NO: 579 - DNA, 4751 bp, Homo sapiens
agagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattctaaaaaaaaaaaaaaaaaa

SEQ ID NO: 580 - DNA, 484 bp, Homo sapiens
  misc_feature (356)..(356): n is a, c, g, or t
  misc_feature (359)..(361): n is a, c, g, or t
  misc_feature (372)..(373): n is a, c, g, or t
  misc_feature (375)..(376): n is a, c, g, or t
  misc_feature (383)..(383): n is a, c, g, or t
  misc_feature (396)..(396): n is a, c, g, or t
tttggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtcagttctgcaggctgtacaggaagcatggctggggaggcctcaggaaactgacaatcacggcagaaggcgaaggggaagcaggcacgtttcttcttaatattcctttgaaattctttatggtgcacaggtagcgtagaaaataactgcttcacactgactgtcatccctcctgggtggggggnggnnngaggttgtaanntnnccatagngataaacaccagncgggtcccaaccttcccgatacatgggagggagaaaatggggcattactcaatgcacaaagggggcttagaagctcccccccaaagcc

SEQ ID NO: 581 - DNA, 2100 bp, Homo sapiens
aaaaagccagaaccaggcctgtcccggacccgcgtcccggggaggctgcagcgcagagcagcggggctggggccggtggggggccgtttgggacgcgcggagaggtcctgagcgcggtggctctgcgtctcctagctctgatctccaggctacccctgtgattccgcgcagaggtacctctcggaggacgccggggtcccatgggcggcgccgcgcagggcgctaggaccccgcggggagcggaggcggcctcggcccgggagcctggaggacctggccggtcgatccgcccgggctggaaaactttctttataattacttctccaggtcggagcgcgcggcttgctaggcgcgcggggccggcgctgttacccggcgtggagtcgccgatttttttttcctgcgggaccgcggggccccccagactagcggagctggacgccggggcgagcacggggaggggcgcaccgagggaggagacaaacttaactctggggccgggattccgaggcgggggccgcagccctcgaggcccgaagccaccgcttcctcccccgcctccccattcaggtgggcgccaacggcgggagcgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcccgcgccgcccctcgccactggcgctgaggcctgacgccgcctgcgtcccggctagaggcgcgcttgcctacaggtgagggaagacccccttcaccgacagtggccttaggcctggcaaggcgccacgacccgcccaggagccccggagggggcacagctaaaaacaccgctggagagccccgagcttccacgacgatcgcagtaaagaagcagtttcatctgggcaacgcacactgcgctttaatcaagttcctattcaacatagtcccagtgattaatagcccaactgcttcgttttcggtccagagctcataaacaagatatttttagcttgacgcttttggacgggagggagtaaaaaccagatacgttaaataaatatcccgatgtgagccggagagctgcttgctgagccaaatgcaggacccattcatatagcattcacctgtggagggagacctggacggaaatcaaaaagcaccaagagcgatttgcgtttttttctgcggtgctaaaactaatggcttttcctacctaggaacaaagaaacgccactgtacatgcacggttcccggcctgtggagttgtgggaggaaggcgatgtctggccttttttgcacagctgctgttgcctgcccggagatcgggaactctgccccgtaggactggaagaaacctcagtaatgggaataagactttgtccaatagggggctgatgaatgtgtgggggcgacaatggcaaggagtgggactcccggcccggggttcgccaaccccaggggccacaggtcctcctacaattgaaccagaattcacccacccgggcctgccctgtgcagggtgccgagagcccagggatgcatgagagggtggctcctgcctctgggaactgggacagtgggagagacggataagttgtcacacagaggctgctgggaggaaggaggagacagaaggagtaggggatgggacttcattcgttcatcaaatgcacacgaggcacaaatgggaatcaagggtggatgtgctgtgatgaagagaagtcctgccctgaacaaggtggcgctgtggaggaggcagagatcagatttgtctgcggaggtgttatggactgaactgtgtccctgccccaaattcctgtgttgaaggcctaacccccatgtgactgtatttggagataaggcttttaggaagtcattaaagtgagatgatgtc

SEQ ID NO: 582 - DNA, 1507 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaaaaaaaaaaaaaaaaaaa

SEQ ID NO: 583 - DNA, 594 bp, Homo sapiens
ggagttttaattcttctttactaatccatctagacaatgatgcagaacagcaaggagaatttgggaaccagacccccaccttcagcagcttagctttcatggtggatgtgatggttgtggggttaataaactggaaggaaggggcggcgttgtttgggtactgtgcagggaacttcaccagcatcttgacacgatggttgctgcagtgcacagacactgtgcagctcctgtctgccgcatccatctccacattgacattccggatttgcacattgatcagggagaattcctgctgcaaggtctgaggcagccccagttgatctgatttcctctcttccaggagatttctagggggatcttcttttagggcttcttcctccccatggcttgcagtgtgctggtgatctgtatcttcagtgtgcagggtcttctcaggttccggcagaagggaaatactctcaatgaactcatcaacaccatctaatatgtcatttgcacaaagcctctgcatctgggaatccacccgccacattctcaaggtctgatcccgggaccacgtcaccagttgatagtccttggacccttccttctgct

SEQ ID NO: 584 - DNA, 581 bp, Homo sapiens
ttttgaggagtaataatttaatcagaatatattcctttttgacagtttagcaataaacatatgacccttccttctttaaaaatgaagaacaaaccgagagcccagcgccaagcctacagggcggcaagctcagccaggcgcgccatcctgcggagctggctcccgtgcacggggctgtagcgcccaggactgcccaggcctggctttgcggggttgcttccagccacgctgtttctccccggactgtagctgtgagggccactgagatctggcagctgagacttgaaccttcctttcaccgcgggactgggccaactctgtctgtccgagggtgagtagcacaggacagcactcttccatctgtgcacggccgggaactgatgggggtcgacgtctgcacattcaagagcggccaaaacatcctgatcgagttttgatggctcctctccaaaaaggaagagccgcctggccggttccctggtgacctcgagctgatcctcgtgcctggggctgctgggactcaaggacattttagcgatcctggctgacatttcactttctgtccttctgtggccattccc

SEQ ID NO: 585 - DNA, 2427 bp, Homo sapiens
gacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcagcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 586 - DNA, 629 bp, Homo sapiens
tgggagggagccatgaagcattacgaggtggagattctggacgcaaagacaagggagaagctgtgtttcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactgcacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcagctcacccctgctgaggctcagcccctcaacccggtggcattctgggggaggagtggggcccacagctctccagcacccggaataaagcccgcctgtccccagtcggaacaaaaaaaaaaaaaaaaaaaaaaaaaaaaaa

SEQ ID NO: 587 - DNA, 3703 bp, Homo sapiens
aatcgcctccggctgcgtgcccagcagccgccttccctctcggtgccaccgccccatttcaggccccgcccctccctggaactgcctaggcagaagccggcaggcacgtgaccccggcgccccgcccccttgcgcttccccggagattggctcgggaggcgcatgcgcggagagcccgtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaaaaaaaaaaaaaaaaaaa

SEQ ID NO: 588 - DNA, 4406 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 589 - DNA, 463 bp, Homo sapiens
gctcgcagactgtgctataaactgcaatttctatttggggtcctcacggagaagaacaccaggaaagacagacaggaccagtgccatgggccagctttgctgctttcctttctcaagagatgaaggaaaaatcagtgagttggaaagctcgtcctctgcagtcctacaaagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctag

SEQ ID NO: 590 - DNA, 2059 bp, Homo sapiens
cggggcttcatggggagttgttgggctgaacgagcggctcggagtatgggattgggggagggggacgggggagtttggcgcaaagcctgctggggcatggagtcccggcgagctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaaaaaaaaaaaa

SEQ ID NO: 591 - DNA, 2149 bp, Homo sapiens
ccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactc

SEQ ID NO: 592 - DNA, 1853 bp, Homo sapiens
tgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcact

SEQ ID NO: 593 - DNA, 452 bp, Homo sapiens
ttcaaagacagacacagtttatttataaaccaaagaggccaggagcctactagccacccccatccccttccctcttcctgagcacagacatggctcccccacctcctcacaaggtttttggtacaaactgtggtttggcctaaagcatccctaaggaccctggtggggcagggtaccctctgctcccaccacctgggatgtgctggggaacgtggagtggggcagcctgatattgatatcccgcggccccggccagggctctggagctgctctttgctgcgctcatccaggacttccacgaacttggctggaaaccagcctcgcaggccgttgagctcccccacccagcagtgctcgtccttctgagacacgattgtgatgatgtcgttcttgcggaagcccagctcgtcgtcgtcgtgccgctcaaagtccagcagggccttggctcggcg

SEQ ID NO: 594 - DNA, 5969 bp, Homo sapiens
gaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaaccttagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccagattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacacactccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgccttttttaagtaactgagtcatttttaccacacagtccagtttgcatgtatagctaggaaacatgtattgctctagattggacagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagt

SEQ ID NO: 595 - DNA, 2155 bp, Homo sapiens
caactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 596 - DNA, 2387 bp, Homo sapiens
gcgcgcagcccgcggcggccatctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaaaaaaaaaaaaaa

SEQ ID NO: 597 - DNA, 834 bp, Homo sapiens
gtcgacccacgcgtccggtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggcccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattctccctctaaaaccaacacactaagacaacagaacccgcagccacacatcacaggacagtcaccacctgacacaacgcaccccgctcgaacgccgccttctgagcacacgccccctacgtctagctcagcatctcgacgaaagaacgttatgagttcatgaacgaaagactggcgggccggtatgattattctctcctcggcggcggcgcctcattattaacctacacgaagttatcgtagaagttgctctcctagcggggtcattatctaatacacggccggtgtggtttgtcacgcctgcgtgatccacaccgccccctat

SEQ ID NO: 598 - DNA, 711 bp, Homo sapiens
cttttttttttttttgcgaagtgggctcgtgggttggcagtatgagagttgtaatggcccgactgttgagtgagggggagcaggggatcccaacggcttgcgctgcctttgcgcagcagccggcgggcgagccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagt

SEQ ID NO: 599 - DNA, 1378 bp, Homo sapiens
ctccgctttcgcgggggctgctggggcgtaggtgtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattacagtaaaaaaaaaaa

SEQ ID NO: 600 - DNA, 2115 bp, Homo sapiens
agttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaaaaaaaaaaaaaaaaaaaa

SEQ ID NO: 601 - DNA, 2320 bp, Homo sapiens
agtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccaaccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatgaaaaaaaaaaaaaaaaaaaaaaaaaa

SEQ ID NO: 602 - DNA, 3422 bp, Homo sapiens
ccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaaaaa

SEQ ID NO: 603 - DNA, 2382 bp, Homo sapiens
agttctcgctccgccccccacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagtaaaaaaaaaaaaaaaa

SEQ ID NO: 604 - DNA, 2048 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaaaaa

SEQ ID NO: 605 - DNA, 2640 bp, Homo sapiens
tggacaacgcggaagcccagttcaccacggccctgcggctcaccaaccaccaggagctgtgggccttcatcgtcaccaacctggcgagtgtgtatatacgggaaggaaatagacaccaagagctctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggccctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgctcggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaataaaaaaaaaa

SEQ ID NO: 606 - DNA, 719 bp, Homo sapiens
  misc_feature (520)..(520): n is a, c, g, or t
  misc_feature (645)..(645): n is a, c, g, or t
  misc_feature (682)..(682): n is a, c, g, or t
acataaagaaaattttcatttatttttccctcagatatacttcaaaataacatgtagacacagaatcacaaatatatacaaaacaaagtatcgcctggttatttcaagaagagttttccctcaattttcttagctgctgtgcataaaattcaaagctttcagggggttcaatgaaagggacaggctctccagcatacttcagcaaagatgcgtaacgctttagaaacagatcatccaattttgtattctttgcagtcaaatgttcatacagtgctttagcagatgtgacatctttctctgagacatagcttttcatgagggaattgtatgcttcttccttttcatttaattcaggaatcaattctaacacagatttcacagttgatgcctttccttgtttcctagaattcctaaggaggaacaacaacaaaatcggggtttgttcagcaattgcaccacatctctgtaggagagctctggcatcatccaccttgcctgcatccacaagttgaaggaaaanatcagtgacaggtttataaattgcaaactgattggccaatctctccgccatgatggcttatctttcaaactgctggtccaactgctcctctattactttctggataagatgccaaggccgagtantcgggtcaatgactttatcctctgaagtaagctattntcatggtttctattgcggcatctatgtaatcattctt

SEQ ID NO: 607 - DNA, 162691 bp, Homo sapiens
gaattccaaattatccaaattctcatcaacagagattgaggactgacttacctatttggaaaatttggaaaaaaaataacaaagcacagatggcttgattcatttctttcttatattgtgtctgcctgttcagagaatgggatggtattttcagatcttgttccatttttgaggatatttggcccagaccccagctgtacattctggattccagatctggaggccaatcttctctcactccccaagtaagaagtgtatgtgaggcagcatggggtggctggtgtttctatgttgcagttgcaagcatttcatcaggtcaccatttaagagtcaagatttgaaaggaatgtttaggggtcttggttgtgtcatcatagctaggccaggttatctattattatcaataataatgctgatttttgttttgttttactttttgtttttgttttttaattttaatagcttttattaagtaaaaataatcaggtaatttgatacagagtaaatagaatttagctcaaaatcaatttgtattcttcacttttttgaatactccagaacaaagatatcatgccttctatttttcttctagatatgtatactatttgcatctaggacatattataaacttgtaaaccacatttgagagtgcaagcacaaaaatcagatgcatgttactagttaacagtcttatttttaattggtgccttttcctaaatgataataggcaaatagcaaccatttattaattatttttgggtcaaaaaggtaacattttcaaattgttatataaaagtaattaaatattaaaataaaaaacacattacattatatagagatttaataccaaccttgaaatcttaccagcaaaagataacattgttttattttctcagcatgaagtctgacctgtgctatcttttaccatggggttattttgaataaaatttttctcaactgaatgacaatatgcaattgaagtatttttttcactactgtcattagtaacagccataaaatttatttaaattaatatgtaaatatactgcaaaatgtagtaaaatactatattgatattgatggaaatgatggatggatagatatacgatagtgcaagtagggtaaactgttcattatagaatcaaggtgctggatataaagaagaaagaaaatttaaacacaacatagtggaaataaagctgattttcaaatattgtaataggctgaatgtttgcatcattgcaaaattcatgtgttgaaacttaacccccagtgggatgctattaggaggtaaggcctttgggatataattagattatgaagatgaagctgttataaatgggattagtgctcttatcaaaggagacacagagcgctctcttgccctctttctgctatgagactgcaatgaaaagttggcagtctgcaacctgaaagaaggtcttcacctaggacccaactatgctgacactgatcacagactcccagcttcaagaacggtgagaaataagtttctgttgtttataacccacatagcctatggtactttgttatagtagcctgaactgacgaagacaaatctctatttgccatattgcgtcttctgtgtgtctacactcaaagggttgagtcatttcactttcctaattcagcacagctgaaataataagtagtagaactgaataaatgccatctcttatcatcgttattacaaaccataagttccacttttataccttagaatttacaatgagcaaaggaaaactataattcaaggtgaatattgattgcttccctttacctcttctctctgcttattctcttctttacttttagcctgatcctttaaaagtaatttcaggaggtcttcaggtctttgagagtgaatagatcttcaccagctttcacctgaaacttctgtgatagctaagggctacaatttaaatatataaatgaatatgttatacatgtacatacatatatgtgtgtatcacacataataattatgataaaaaagaaaagaaactgtattcttttatcatgataattatggtcaataagaaaaaaatgtgtattctccaatgtctatgtatatacagacaaaatgtgtgactttgaaataaagagattgacattatatgctgttggtgcacatgacttttatttctttaccattacacatactataccatagcttatgacattttatccagtttagcacatgataaattattgtttccaaaaaatgttgtcgcaaatttaaagttaaagcaaagaaactgcattcgtataaatggctgaccttctttgtgcttaattgaattaaaatggatttaatcatttcttgattgcttgcaaatctctaaatctagtaactgtagaaaaaaagtgaacaatcaatattttatccccataagactgacaatgacattaaattttgtgtagtagaaaaaataaaaacagttaatgtatttgagttgaaataaaatctggaccactttattcacagctggcatctttcttttgagatgctttgtattttaccaaactaccttgaatattttctacaacaaggtgagttttacacacacacacacacacattcaaagtcacatttccacagaaagaatgaagccagcattaaaagaatgcctctaacagcaattttatttcacacaaagaagatcgttcaaagaatcatatcgtaataaaaagaatcagcatctcaagtcccagttttcaaatttcatcttgatatcttaaggttcatttttaaaagagtctctttcacatcacttgaacattttttgaaaatggggcaagagttgcataattaaattgcaaaacaaaaatacattgtatcatattatctctgagctgaaggttttcataaatgatctagttttaacttcttatttaacaatggaaacaaattcagtattgtgattttaccaaagtcacagagccaggcttttgaccttagagactgtgttttccaatacctgattcttacaaagaatcagcaaatacaatggggaactggtgatatttatgtcaattgtatcattatttccagattttcttcattaacactgccaaacgttttattcaactatttccattctatctttcctttcaaacacaatattcttggcaaataaagcatccataagtacacttggtctatctttggggtttctggcaattggcattttaagataagcacacaaacaaaggcagatggcttcgggcaaggtatcttgataatattcaatttttctctcatataaagaaacatggcttcctttcaggaagctatactccattacaaggattagagtaattatgaaactattctttgtagtcatcacaaatgatactttgaaaatgaatattctatatattttttacagcgctgtacaaaactttaccttggagccatttgtgggggaaaagaagagccacataatattattaaatatctagagacagtttaacaaatagtattgcctattagaaaaagctaataaaacaattacataagaatattttaaaatgcagtaaatacatcactgaaataatgacaagctctgtatgtgttctcaatttattattttcatgcaaatagatgtctctaaaatgcctaacgagatttatttacttgtttattttcctctctctccttccttccttcattccttctttccttttctccttctgaaaatttgaacttttttttgaaagaggtaaagatatattagtattttaataataaattacctttctgggtgccaaatataaattctaatcattttgttttattttatactggtgaaagtaacaaaatagaataaattggacatgttgaagaatatttggaaagaaaacagtttgactttgtatccaaatgttttatgacatgttaaataaaatacaagtaatttcctaacagtggaaatttattagaatgttgcttaaataaaattcctctggatatattactcttttgaagtaagattaaaaacagcattccaaattcacacagttattctattctgtaaccttttcccttcattgccctattcccagattgctggagttaaaggacagattcctgaaatagataattctacaagggcagaaacatcactatatctatgtttcagagagatataaatatgccagagacttggagtttagtcacaattacattgaattctactggaacctgggtaagggcaagagaatcttctgctcagttattgctttcaattttccaacttaatacaatagttcattctaatactgaaagtaatggtaatctctgccaccttccaccaagtgcatgaattatgtgagaatagaggtagaaaaatatgtaagaggattcaccatctcttagattataaagaaacatgaatcctttttctgcttcaaaatgatatgcatagttctaggcagaaaacaatataatttcattcaatggtagcatctgggatcttaggcactttcctctgttcttgttcccacatatgaatagtgaaaactgtggtctcttcaccatgactacagttctctcccttcatgtcccctcaggacatattgggcatgttcccttaggtctattgggaaatctgggtcccctgcaccccagaaggtgcccatgagggattaaggtcacctaaattactttcacttgccaaaatcactgaacagtttcccatacactgttggaaatgaagctttttggaatttttcctaaaatttatagccagatttaccattacctgctctatcattagaggtttcatgccatggtctttctcctttttctgtaattctctaagatcgtaagagtttgaatttgtctttttcatttcttcatggttatatatttttattcttccctagacaaattgtaaaactctagtgtgcagttggccaggatagatataaaaatttgaaaactctttatttcccaatgaagtctgactttcaaatttattctctggtatttgggaagtgagagactgagtatttactctttttgtgtttaaatttctggtccagcaatcctataacttctttctattctgaagccccatctcactaggaggctaagaaaaggacatgagcaataacatgcaaaaagaaaagtataggaatatattttgattcattctctattatatatttaactactaaatgcataatttgattagttaaatattaatagtctctacattttaatgtttacataaaattttactgcttagagtatgatatgaaagctatgacttttttcatttctaaaagaaagcttaaaatgtgaaaaagaatgtaaatcaggtaaaagtaatagagaaacagttgggaaaatggaaattaaaaactctgaaatagattgcccaggctcagaaattgtatatcagatttgaatcatattcctgtatagaacaggttggctcgaatctctcctttgtcttctacgcactgctgctctacagtagaccttcattattgcgcccctgtgctaagacaacatgtttcccatcttaaagctctgcttctgtttctatgaccctgtcctccactctggacactttctttcccaaacacaactctaggctcaaatcacagtagtcccatttttttttttttttttcttaaattctgagtgtgtttctgtagcactaaacgtgtttggcattcaaatctgctacttcattgcactaacttttcctctacagagattttttaaaaatttttactattaccattctctcttacttctcttccactacgattcagcaacatgttttcaccagaaggttacattgtttcattgttttgtctattttcttcttcatcttcttcatctatgatcatctttttactgataactctatctttctatctcccatccagtctattggaaaggctcagacacatgaccaaagtatgctatgtcttctcagcatatttctctgtctttattgttgatactgacttcctcgtgtaaactactggagaaccccatcaatcagaaaagctgtttatttaacttgctgaagcaagtgagaacaccatcttgagatattttagtactatgttaaaagagagaaaatagttaaggttacttatagggatttggggtctgagatcaagtggtttaaaggaaagaaacgggtttgtttttgacaaggtgtaagacaatattttaggattgtgagaaaagtgttctgtgacaagttttaaaaagccgattttgtgattttaagtaaactgtttatactgaagtgcaaactatcattttaattagacacttgattgcctagatgagaaaactgcccaaaaaatggtttccaataattttctaaaagaaacagtaaagttattgatgatgtgcaaccttgcctcttgtgcaagaacttcctggagcaagtagttatgttgatacagatattctcaaatatgcatcccaacaattatgttgatgccagtgggctcaattctcagtccctgtccattgtcatattcaatcctaacaaaattctatcagaatttaagttataccaacagaacagattgtattccaatattaacagaatacagaactagatatagatatcagctaaatggcctaatttaattgtttattcgttttcctggagctttttcatattatcaagatcatggaaagttctagggatgtaaatacttcattcatcccctaagatggcacatgctccttctcaaaacgtcaaattagagaaagggctgttttgttttggttagctgtttattctaattgatgaacttctacggcttgttgtctggcctcagtgactttttttctggtttcttagtcattatctgaaccacagaagtataatttttcacactttctggtctccttgtaaagtgtgaaatgtagagacctgaagacagtccagaattcatttttgttggtttaaatttggggtcacaactcaaggactgaattttaccttcatgaattaagttattgagtgatctctcttcctcttttttttttttgttgtttgttgagaggggataaattaacatataaaaatgaagcctggattcatttgaatatgagactatcagcaaagctggcgatagtctcccatgttaagtccctatccagtttgcgtgtaagagcttataggttttggtgcttaaaatcaaataccagtttgattttaatttggatgctacctaattatctggattttagcaaaaggtcattaaaggtagctaacttgtatgttctcaatgtcattcaataagagcagaaagtaaggcatcatcaactagggatctgaaacacagattcacccaaatagtgagtgttcctgttagtctataaaagtgagacagctttaatatacatacagtattttccatagtttcttaacaagctctatatttatttatttattaattttgagaaagcctgtggctctgttgctcaggctggagtgcagtggcatgatcttggctcaccacaacctctgcctcccaggctcaagccatcctcccacctcagcctcctgagtagctggtactacaggcaccctccaccctgcctggctaacttttgtagagacgagattttaccagctggtctccagctcctgagcacaagtaatctacccatcttggcctcccaaaattctaggattacagatgtgtgccacagcaccctgccaagctctataattatgaaagttaagttacaaagacaaactccctaaaaggttcctagatttttccccaagttacatgtgagggggatttttttttagctatttgcctttttgtgatgtttaccttctaacaagtgtgtttactgattaggaaaattaaagttgaaacaatgcattccattagaatagatctggctcacacccagaggaatatatatatatatatatatatatatatatatatatatatagagagagagagagagagagagagagagagagagagagagagtcccaatagatgatttgattttagatttcagccaaatcataagcacattgtagctagatattagatttatatcaagaagtaacctggtatgaaacaagcaatattaagtaaaagggcttcaaggcatcatagttaagagctaactagtgttccctgcaagtcagaaacataaattaacaaagagaagaaaaaatagttataaaaataaagaacattaacacacattaaggcataatactctgctgtttctgtacataatactctgaatcctgttttctgggtattgggcagaaactttacatagtttctacatgagcctaaaggtggctgcttctggagaaactgagtattctcagtttgaagtctctaggaagaatgtccttccaccaacatgagaagagctgtgtctcctaaactgatagttgtcattccgaagaccagcctcttggagctttgctcatatacttatgtgtcctattcataggattttataggctgtcctcaggattttcttccggaatatcagatcttcaggatttaggtcatacaagagttgtctaaaacaatgttgaggaagggccagctgtacctcctgattataagaatgagtgttttgcacaagtcctttgaagtatatgtgctgccgatttgcaataaggcagagcctataatcagcatgatatctctaggtgggtgagttggccttttactaaatcataaggtgatagtaagagtagattcagcacaaaaatgtatttatttgatattaaaaccaatgataatattttaggccatctaagatcaaagtttgttaagtgctttgcaaattttactttcagattatgtttgctcttcctaactgtactgaaaattgagtataattcaaacagtgagatttctgggtaattagcaaggctttgcatttctctgtaatttctgtcatgccaaattggtgctcttttctctggataaatagacaggaaatgcccagactagacatgatgcaatatttttgctaacagtaaatcagtagccctccctcaagcaaaagcttcaatctatcatggaaataagcaaacaatgaccaaaacattcttaaaatttattgcaaggtatactttatgttactcatttgaatgtgttcaaaggggccctaaggctgggcctcttgtacatatttcatctgtaggtttaccagaactacagtgaaatgacaggtgagacacaaagcagaggtccatcagcaattttgataaagtcccccactccagtatttgttgcatataatatgcttgttgtgttcttgctgtggtgaaaaatgtagtataaaattattgcaagttttttggagggatagaaaatggctgatctgaaagtgacaaagtttattttcttgtaaagtaatatataaccagatttctcccaaatgttttttttttaattatggtatgcaattactggcattccataagggcttctttgaacttctttaaaaaaatggccttttgcaatgtcaaggggccaagatcttaattaaagctcctgtctttcataatgattactaaaacccttccctttgccttcaagtaatccttttttgtgccgacttctaattttataatgactatatacttcaaaagcatcagggaataaagagtactttaatctattggacattctgaattggaattcctggtgatatcaagaattagtactgtttccaaagaattccaaaatgacatattatatgcagaatgtgtcttctgtcacaataaacattagctctgttatctctagccatttgtcaagatcaggagtgtggactgtgttctgtcatctgagctgatgtggtctttagtaagaggtcatatatgatgagtaagttgatctgttttgacacattctgacaaattcttgttcttttcttaaaataagacccactaacaagtaatattgtatctatattttatataagaatttttcaaataaatatgttggggtacaaatatttcttggcagagtccagtcagtcatttgcatctccttttgctgattatgaaaataaagtaccatgattttaagaataatgctgatgcttgcaaatatgtgagggagtaatagaattttataggagataaacttagttggtaatagacctatttgtttagacctacttgctgagtattttaaatgagcaacaaagagtttttagcattaggaagcattacatttaaaagaaaatctaaattcaaatccatagagggtttcattacttcagcttaagctgttattgagctgaaacagggtgaataggcctttgtcagaggtaaagagacatgttataataaattcatggtgtctagtagttcccctgaagttgagccagaacaccgaaggcctgtgcagaccatttgttcatcgatgaatgagatgctattgaagacttattttttcttaagaaatggaagtgctgagattacaggtgtgagccactgtgcatggctcctaattttaaataataaaaaattagctcttgcttaggagttagcccattcaaactttaattgaattatgcattctcatagtgatttcagaaaagtaataaacccattgtttgtagtgacaccagtgaatcctgtaattatctcttgatgaccatgatggaaaaaaattgatgtctgtttgaagtgacaggtttacacccttgtgatatattatgtcctatcctttgctttgacaaagttatagcttttccttaaaagcattatggtctttttaagaaacaaactgcataaatttaaggggtataagaacagttacgttatacagatatattgtgtagtggtgaatttggagcttttattgtaaccatcacccaaataatgtgcattgcatccattcatttctcattcttcacttccctcccacccttgcacacttccaagtctccaatgtctattattccacactctatgtccatgtgtcacattagttagcttccacttataagtgagaacatccagtatttgacttactgtttctaggacgtttcactagaaacagtaagtcatgataatggcctccagtcccatccatgtttctgcaaaagacatgatttcattacatatattcctttgtgtgtgtggtgtgtgtgtgtgtgtgtgtgtgtgtatcacattttctttatttatctgttgatagacagttaggttgattcattatctttgctatcatgaatagttctgtgataaacataaaggctggcatcttgtttatataatgattgtttttccgttgggtggatactcaatagtgaaattgctggatcaaatgacagttctttttttagttatttgagaaatcttcatcctgttttccatagaggttgtactaatttatattcccagcaaacatgtatagcatttttttcctctgcatcctccctaacgtctcttgtattttgacgttttgaactaggtaaatacatgaaatcaatcttagatatcatttccccaataatccaaagcaagtggcgatccacttattttggattaaaaagtaaaagcagagcgcagatacacgatgggaaaatatttaggcttaagtgacattgaaggtaaaatagtacttgggttcagtgtcatgaaaagcagaagatgactattttctttttatggtccaggagtgtggagtaattcgatatcctttcctgttgtacttggtgactaagaggataaatattacaaagatgggtacaagtatcatgaggctttgttcctaccaggctttccgtgttggttttggttctatattgacacagtgttttgaaggaaaatgtacaagttgggaagatgtgtatgtgagagaatctaaactttaatatattcaacaccaataagtctgtcaatatcaacaggatacttggaccataagaagactaagaacttctgaagattttcaattagagtttcaacttagataggaggaaaacaataggttgagattcaaattacttatctaaggaagaatactttaggagagcagttaaagaggtagttccatttatgatatctttgtagttagcaggtgtggtttcacaagagaaaaaaacattctttggttggaagtacgctagtgagatgtattggctgaaatatggttaatgtttgaagtttgttttctaccccctgaagaatttttctttccaagggtgagtttgggtaatagtggcaggatttaaggttaatattgtagcatatgttatcaataaaatgttttcaaagattgttctttaatgcttacagaactttcttctgaggaatttaaaagaaacctgagttaagtgcttggttccatttcagagtacattatttatccacattattttagtcttctagtttcttaactagtacaggacaattttatattgtgaggatctatctgtatgagtttggattccccagagaaaaaggaccaataggatgtgaatatataaagagaaagctgtgttttaaggaattgattcatatgattacagaggcagtcaggtccaaaatctgcagaataaccaacaggctggagacccagcagagaggcaatgttgcagttcaaatatgaaggctgtctgctgcagaattcattcttgctctgcagaggtcattctttttgttctattcagacttcagtttactggatgatgctaacccacgctatggatgtccattttacccaaagtctactcatttaaatgttaatctctttcaaaaacattcttactgaaacatccagaatagtgtttgaacacatttaggcactctggcccagccaagttgaaatataaaattaaacatcataagatctaaaagaataggatattgaagtgtagttccttttttgttttcccttgtcaaattatcctttgcagaacaattttctaatttcagtttttcacattttctcacaaaaaattttaaaagcaaagcatatgatattttacatgttaccaatttcttgtcctaagttacctctcaaaagaacaattgcgttcgtatcaacagtatccccagctggccactataactttgtcatttagaaagatagttgaccaaaagcaaagcctgttgtgtaaagatgtcaaactgacaagacttttgggacttgttgacccttggaactcaattaagggacagatttattataatctatgtttattttcttgtctacgaaattcctcttataaactcaaaacagaaagttgaaaggacaatccaagggaaaaaaaaaataatgccgtaagtaaatggacagatttttactgaccaaatgctaaagaaagagttttaaaaactgatgggctaagcaaaagatttattttaaaatgttattttatttttaggagacaaagttacctcagcattgtattcagacccaaagtgggacctacctcactattatagtcagaacaacattctaagcaagagactcagggagccgcaggtaatgcaattttctgagagagccttaagacttgatgaccactgggcaagacatccagggctgcctactattgactagggagtagttaagttaggaaaaaaaaaattacctaagttattaatcaagcaatgctgaatatattaaatttacagtatcataaaagaactacatcttggcagagtcttaatagtaattcaaaatgtggaagccaggaaaatatacgaatggggttttgggaatttggatttgatttaacatagctcatcccaggcaggggactggctggcaaagtttgtaacacaataggttagaattgattgttatgaaaagatgacaaagtttgattagaaaacatttattctgactattaagctttttgtccaggtgagcacactattgtcttgaggagccaattatttgcccaaatgagaaaatagttttcagagataaattgtgtgtcaaactttcctgaagtaaagatcaaagatgttggatgctttgcagtcttattgtcctaagcaagaatttcctaaagttgatttcagttttcagtcaaaacagttgctatatcactataagttatctcaaaaacagttaagttacatctctgtaagttatatcaataatggttattactattgatttgcttttgccatattatgaacttactatgcacatattttcggcttcttatactggtacttaattattatacttaaaagatattttacctattcagctttgtatcctctctggagcttaatataatgttgtcaaataaatatatggtaagtgtaattttatttttggttcaaattaatcaattaacccaaagtaggtttgtttaattcaagtttctatttcaaaatatttttgtgaaaaattattgcaatacattgattaattttattgaaatcataactctttcattagggtattaagtttttcttcattcaagacttactgaaattattaagaaaacagtaatggcatagataggacattgtctttagaaactgagaaacagtttgaatatgttttgtggctgattacttcccacaaaaaaaaagctgtgggaaagaaacaacctacaagtactacataaggtaactgagacaattggaattatgttaacgtcttatacttagtggtgaaataatgtggatatcaggtaaatactctctgttatctctaatgttaaaatttctcctacaattaaatttctttcttatatttattttagggtaacagggcaagtaaagttgaatttaatgctgagaataaaagagtgagaccaaaaatgaaaaagaattgaggttcaggaggaatcatagaatgtttgaatcatggtgatgttaattatatctaaaagacagatgttgtgtgaataaaacattttagtctcctggaaaaatttaagtaaaatattaaatttaacaatgtgtttgtgtaatatttttgttatttgtcttaaaaaattgagataattctgctgaataacaatagttagtttttctgttgaacaatcacatgtggtgtcctgggattcatgaaaagattctttccacaattactgatttgttaagaaaatttattcatgttagttctataccatcttaatgaaaagggtgctcatttacctcatttggagaacattaaaatcattaaacatgactcatttcattctctttgattttagttcttctctcatttttatgcatgctgattgaagtggaagagtttgtttctttaatctcattttaaacaaaagagtgggtctgtgcatcacttattctctttcttcataatgcccttttcttgttgaaaagaaatgatgttattttccaagttaggaactgtgaaagctatatatcttcaggggacaacaaaaacaaaactcctcaacaaaatgtgataaaaattagctacaaatttacataaattccataatgaataaagcacatgcttaccacattctttagtatgtaccttagtacatgtctttctaaggtacgttttttaaattgcatattaacattaactttcattttgtattagttctgccattgaaccacatgatcccttgaatatatataactaaaaggcaataaattatcaatgagcacagcttggctctaatatacaactttcataatatgaaaacatctattatgttatccaaatagcttactcttatcaaattgataatcataatgaatttctactgaaattttctctctctttcaatatcaactgaagttaatttttgcgttatcttttttatgacattttcaagggaacagaattgctgttgctttttaataagccatgacattctccacctttcttctaatttgttttaaaggacacctgaatatattctttatgccttgtattcaaagtgaaaatgattataatatgcatacttttagattttatatttttaaaatacttctgacttcttgtctaatttaataatttttgattagccaatatctgagaaggaacccaaataatatttaaataaattacactatgtcctgtccttgtgacccacatctctgtaatgtttcaaatactggtatattctcttggctgtcacacagttgacatttcagatttctgagagattgatgtgtcacaagagatttgagggtgaatgaaaagttgaatatccacagcaaacatctaaaataatttttctacattgtaatgtcacatcattacccttcagaaggcatcgtactttatagaatgttacataattatttttactaactgtaattattttcaagagttgtttggtttccttgaaaaacacattaacataaaattattcaacagctttaaaacacaaatatttgtgaattttatatacttaaggtatctactaattttcatctggatgacaggaatatataagaaaacctagatttaagttttatttgcctgtctgatatcaatacttttaaatatgtatgataacatttaattgctacatttattgtaaacagtggttatgagtgacaccaattttccattttaaatgttaataattgaatattaaagaaaattttaattactatgtcataacaaaaggtactcattatttgttttagaaaactatgcttgtgaaataaaggagaaacttccagctgatacaaaaagaaaaataaaaaaaacatgttgctagaaatacttctttttgcttttgtttgcttcatgcttctaatcccatgactttttaaaagtgaaagtgataaattactatcaatccgtgacagctttttgatgtgtccccttgtacatgagaaactgagttgagatcacctgaactcatttctcttgggatttcgaacaactataaaaaattgttttgttttggacctggttgggctcagaaatgaaaatgccattatgtcgaggatagcgcatcaatctaatttgctacctggatcccccatctcatccttttccagttgaggctgttttacaatatgcaagacagtatcagcatacttcacactttagttatattttctaaatggctggtttatatttttattaacaaagctgaaacttaacagagtataattaattcaaattgttactaataatttctctgaagatgtgaaaactgcaggactggagtacataggtgctgtgggatttttagtacagttgatatagcagtgaagattataccaagggacctcccctaaataggacaattgatagacaggaacaaaatgctactattatgttatactgggggaaaaaaaggaaagtgtttaattgtgtagtcattttatgcagagttgagaaacaaaaatattgttcttatttctataatatcatcatgaaatatggatttgataattcagagaaatgaggaaatattgatacaatagactcctgcatcattcttattgttatgaaagaggaatttaagaaatatgattctatacaaatttaacaagaattgcactgcttataaatttgcataaaattcttattaaaaagaaatcctagacttgacgagaagcataatctctttttctatttatctaaatatttcttaagtgcctattatgcatgcctataatgtagttgtgcctatcgtgcctataaaagaatatatttgtctaaatatatgtaatgaatccgttgagattaaatgcacacacccccaacacacagatctaaagatgcgttactctgctagcatttcttctgctggataaaatgtctatattctcggcaagtgttctgtttaatctgaggtgcctaaagccttcagggtttcatgcaaaattttgtggagtgtgtgcatgtgtgcccatgtgtattatgtagtgtggaaaccacagttgtcatctttttgtataaatgatgataagccaaaaaaggctaagaactaataatatctaaagtaatttaattctgaagccaccattattataattgtaatagttattataattattataattaccctttacatgtgctactcataccagatgtaaggagaaaagaactttaaatttgctgaagtatgcacagccatgttagagaactattcctaaaaagtagatacaatgacaattgcattttatttatttttaatgttagttccctcaaaaggcagcctattgaacccatatttttaaactactatattgaaataagtaagtgttgtagatgggattaagtgatttcataggatgtttcaagctactcagggaccagtaacaactggaaaccatttccagcactgaaccccaagtaagaatttagtcaacttacagaagctatagttctatagggatgcaaccactttcaaaaacacacaaaagcagggcagtaaagaactatgtaacctgaactcactctttttcttcattttacctccttctatgccttcattggttgaagccaaccagaatccagaaggaaagagagttatccaatctgtatagcactcaatctcccagggctcagagcaggagagaaagaatgaaacatatgcattgggaggtcgatggagaataaacagcacatgggtactgtgtttttaaggctgattcgaagttatttatttcaaacaggactactcaatcatcaaatttcctggaagtagaaccgaagagtctgcattttacaaacagtgctaaggtgaattaacgcaaagtttgaaaacttcaagagaatcacctaaaatacttctcacacaagaaatacacttgtacgtatctttgtttaatcaaaagattttaacaaagttttcccaaacagatgagctcctcactccctaagagtaattgcacaatcttagaaaattttcttaaaatactggctttttatacatagtggggttttctttattttactcttacaacttgtgtgaggaaaatattagattagcaccattgttaaattaggttactgcttagtctggattttactaacaaaaagtattatcttactcataaaatgcctataaagttggataaaataccaatatcaaccatgactcaacaactagtgtcctaaagagtatttttcataaaggtaatattgcgactttatgtaaatttctaaaatttcataaaggtaatattgtgattttatgtaagtttataaaatcaggtgccaatgattttatttaaatcatcaattattgagaaaaccaataagatgttaaaattgctccaaagaacatttgagattttaagcaatttaacaaaatatatttggataaaatacaaaactggaatttttaacaaagctggttaaaatccaacaaggccataaaccactgtctatgttgttatttgtcccaatggaggaaacatactttcatctttactggccaataattacaagttaacctctgtccctacagagttgtatcacaaacaataatacatcagtctcaatactgtaccgacagaacacccagaattttcttttgtctatttctgaatttagaataacttttcagacactaataactatacttaatatatacatgtgaagtcaagatcacctataataaaatttaagagcatgggtacttcattattatgaaaacagtgtaaccaagttaaaactatcctcaatgagatttatttttgatatatttaattaaaaattacattcaactgtttttatattaaacatagccattaaaaatcacaacccaggaaaggaaggtaaaatacaagtaattaaattttaaaaaataatgtgtagattcctgtgattgcaagaccttaaagcacatctggatggaggtgggagcaacacagtggctataaaagcaaaaagtgtaaaagacaacattggtctcaaaaatctcataataaggtaattgtccaaatcaatccatgccccaaggatagtaacacacacaaaaaaatacatattttgtaataaattaatgccatagtgtgtaacagtacaataaagtcagtttgtactggagaagtcagaaaaccttctgaaccaagtagaatttgaaatgagacttgtaggagaatatactttggacgacaagagaatacccacgatggcacgatgaaagaaatagcaatgattcatgtctgcattgatattcaaatattatttgagtaccaattctgtaccaggtttcacagttttcattatgtgtgccaactgtgctcaggtagtcatggtggccatggtttgtttcattttatttttacttatttattttttaacttgtattttgggttcaagtgtgcatgtgcaggtttgttaggtaaattgcatgtcatatgagtttggtgtacagaatattttgccacataggtaataagcatagtacccgataggtagtgaactatataatatcaccagacaactgttaattaagcaaagctctgtttattaaaattctgtaaagtgtgagtacacctttgacagattattagccatgtcttggaaaggagtagtaggtggaagatatttatagggttttgggcctgagatcaaatgatctcagagggttcatcaagccagtgaactgactgggattgagcaaagcctgtgatgtgatagttcaggattggttaacctgtggaatgagaatcttgaaacaatcttaacatgctgtttgatagggaaaattctgtttgactaaagaaagtattcaccttgaagagcagaaagttgtcacagataaattaatctgcaaaaatttctgaaagcaaaagagtgatattatgtactggcttataatcttatctttcctgtgcagtttcctggaacaaacaataaacagtacacaaatggtctcagttatcagtcataagacctaagagagttatgtcaaacttatactaatggtgtctgtgtgaatgaatgtgtgtttgtgtgtgtccccatacatacctgcacctgtttgtgggtatgtttgcattcggtttaatatatgcccaattgtctaacatcctgatcagaattacattttacaaagacgattaaatagtattttaaaagcactacagaagaagccataatagtctttattcactatatttctgatcagcaactcttaataaagatgctttattaacaattataaatagattactgttaatgaagtgagtggagttcaaaataaagtattagctagaatggttgtataggcttatctgtctttacctgaacagtgtattggatctgatgagtttagttttctctattctttgaggtgactcctgacacttgaacctgaaatggtatttcatttgccactgacttagaggattattgttaactacctttgattgtatggttaattgacaatctgatattatttaatttgattctagtgcacattttatgcaattagctgatgaaatgatactgagtcttggaagtgaatgttcaattgttaggtttgggggtatttgttattgttattttacaattagatgtgtagtgtgtgacagaatttgatttgaagcttatttttattgttatctatgaagttagaaaggggacatgtatccctgtttgcagatgacaagattgtatatttagaaaaccccatcgtctcagcccaaaatctctttaagctcataaacaacttcagcaaagtctcaggatacaaaatcaatgtacaaaaatcacaagcattcttatacactaataacagacagagagacaaatcatgggtgaattcccattcacaattgcttcaaagagaataaaatacctaggaatccaacttaccagggatgtgaagaacctcttcaaggagaactacaaaccactgctcaatgaaataaaagaggacacaaacaaatggaagaacattccatgctcatggataagaagaatcaatatcgtgaaaatggccaaactgcctaaggtaatttatagattcaatgccatccccatcaagctaccaatgactttcttgacagaattggaaaaaactactttaaagttcatatggaaccaaaaaggagcctgctttgtcaagacaatcctaagccaaaagaacaaagctggagacatcacgctacctgacttcaaactatactacaaggctacagtaaccaaaacagcgtggtaccggtaccaaaacagagatatagaccaatggaacagaacagagccctcagaaataatatcactcatctacaaccatctgatctttgacaaacttcacaaaaacaagaaatggggtaaggattccctatttaataaatggtgctgggaaaactggctagccatatgtagaagggtgaaactggatcacttccttatactttatacaaaaattaattcaagatgggttaaagatttaaatgttagacctaaaaccataaaaaaaccctagaagaaaacctaggcaataccattcaggacataggcatgggcaaggacttcatgtctaaaacaccaaaagcaatggtaacaaaagccaaaattgacaaatgggttctaattaaactaaagagcttctgcacagcaaaagaaactaccatcagagtgaacaggcagcctacaaaatgggagaaaatttttgcaatctactcatctgacaaagggctaataaccagaatctacaaagaactcaaacaaatttacaagaaaaaaacaaccccatcaaaaagtgggcgaaggatatgaacagacacctctcaaaagaagaaatttatgcagccaacagacacatgaaaaaatgttcatcatccctggccatcagagaaatgcaaatcaaaaccacaatgagataccatctcacaccagttagaatggcaatcattaaaaagtcaggaaacaacaggtgctggagaggatgtggagaaataggaacactttaacactgttggtgggaatgtaaactagttcaaccattgtggaagacagtgtggcgattcctcaaggatctagaactagaaataccatttgacccagccactccattactgggtatatacctaaaggattataaatcatgctgctataaagacacatgcacacgtatgtttattgcaccactattcacaatagcaaagacttggcaccaacccaaatgtccatcaatgatagactggattaagaaaatgtggcacatatacaccacggaatactatgcagccataaaaaaggatgagttcatatcctttgtagggacatggatgaagctggaaaccatcattctcagcaaacgatcgcaaggacaaaaaatcaaacaccacatgttctcactcataggtgagaattgaacaatgagaacacttggacacaggaaggggaacatcacactctggggcctgttgtggggtggggggagggggtaaggatagcatcaggagatatacctaatgtaaatgatgagttaatgggtgcagcacaccaacatgacacacgtatacatatgtaacaaacctgcacgttgtgcacatgtaccctagaacttaaagttaaaaaaaaaaaaggaaagaggacatgtatatccctcattttcctctattaaataataatgatattaatgataagcaatatttcaatgcctctttgccttatgccagtttacaacagattgaaactaatacattaacatggtgttataaaaatacttataaaaaggaacttattcgctaggaagtcctttctagggctggcatttaagttgaaaggtgataagattatcttaaccgatatctctatctaggggaatctaggggaactatattttgtatttaaaagacagagagaaaagttactgtaaagacattggagcaggaagaaaatatggcattattgagagaatgtcagcaggcttttaagacaagaaaatatagagataatggagaggaccgtaaggggcatcagaccatctttggaggtttgatccaccaggacttgctaggctttgtataaataaagcacggagttagatgcagtaagtccacacctaacgtctttgataggttcttgaaaactatgactttgagtgaagcaatgtctaatgaaaccaattttacgataggctaattgatataagcaagagttaagttcctatggcgtatttctggtcacaaatacatcaccaaacttctaaataaagacccaaaacatgtctaatattgaacattgaaataaatgtgagctataaatacatttgagaaagaataataaaaacaagtaaggtaattacccacgtgttagttgcggttcagggttgcaggtgtccaagtctatctggagagctcagaggacaagacgggaatccacgctgcacaggaggccatggcagagcacattgacacacgcacccacacccactcagactggggtaccttggacacactaaccagcctgacatgcacatctttaatatgtgagaggaaaagagaatacctgaggagaaaacccaggcagacacggaaagaatgtcaagactccacacaatggcccctgctgggaatagatttatttattctgatcaatgttattattttttcttttcttttcttattttagatccaggggatacatgtgcagggttgttacaaggttatgttgtgtcatgctgaggttcaggcttctattgaccccatcacccaaatagtgaaaatagtacccaataaaaagtttttccacccttgtccccctctctcccttcttttgaaatcttcactgtttgttgtttccattttcttcctgctgcaaggtctttggttgctactgtctgcaagtcctggtggatcaaacctccaaagacggtctgatgccctttacagtcctctccataatctctatattttcttgtcttaaaaaccctctgacattctctggataatgccatatcttcttcctgctccaaggtctttacagttacttttctttattttcctgtgtagccaatgtttagctcccacttataagtgagtacacatgacatttagttttccatttctgcattaattcgcttaggataatggctgcaaatgaggtaattttgttcttttttatggctgtgtggtattctacagcgtatattacgacattttctttatccagtcttccactgttaggcacataggttgattccatgtctttgctaatgtgaatactgctataataaacatacaaattcaggtgtcttttaggtagaataattgattttcctttgggtatatatctcatctatgttataatgaaatgacaacatttgagaatctgctatattgttctgagtaaaagattatgtatagattttaagaaggatatttatatgatcttatttgggacataaaaggaatattcatgttgatctgtgtggaacggatgaactggaggggcgaaacaaggaagttgagaaactgattagagtgatggtcaccaaaacaaggtagtggagagaagaagatagatacaaatattcttccaagggtccattaatatagatgctgaagtcgccaataatgaggataagagatatcatagaaaggctgtgaaccagtgacaaatatttctaatgaagaatggcagctattctacctcctgttccaaaattatattgtgtcagagagctaaatatcttctacttttgtgtctcttgggaaatagcatcattatggaatagccatattttggttaaagaaaagtgcttggagaatgtatacaaataatatgaggatcttagactcttgtaatccctaggggggaagcctgaggatacagttttaagtttgtataaagttaaaatttggcaaattttatcagattaatggtactgagtcatatgtggataaaaattcattatcaagaagacgtatactaagtgttccttaaaataaacatgactacaagcccgagtaaatagatcctggtgtagatgtagagtgtagggttcctcaagagcccctgaataacacactaaaaattgcatgtctggttcatgtaggaatcattttggaaagaactatggagggccttgaaagctcatataaaaaacttaatttaatcctatggattgcattagatacacggatatgaagaagactttgtctctaaaatagaattcatctcccagacaactcttagttacctgttaactttaagaagaatattacctgtttaattttcagcttatctctaaaattggtacaataactcatttcttgtccacttgacactatttcttagaggaaaacaaataaaattataagtgcttagaaatcatgtcattattaaaatatgtagctatttatttattgttatcttcttccctattttcataaatttctggatgttcaaacacaggacttctgtttacaatgttttcttcactgattgctttttcgatgtacacagttgtgcaattatgacctagctgtaaattttagaagcaactgagagagagggagagagatgaagacagagacagatagagaagagggagacaagagagaggttgagtcaggggagaagcatgggtagaagagttatatgttagtattgtttgtaactatggtgccacttgggagttgttgatgactatgtttcagggggataaaagaaaatctgttccagaaaaagagaaaataaggaagcagacacactgaaagaggcaaagataaagtggaaatcatctattcacagttaagtctctaatctatgtttttgttcctgagacacagctccattgctagccttaagttttgtgagatattctaataatattccatgaaatttcccttttttccataaaagttgttcaaagtgagcatctgtatgttggaatttttaaaaaatcctaatatcatattgaaattacattgcacttagaatgaatcatattgcactttgaatgaaattcaaagccttttctacagcctgaaattccaacacgatctggccctgccttcccttttttacatcatcttttgccagtctcctctgtatgttctagggctggaaagatcatctctgtttttgccctagcatctcgaccctactttttgcatgttgtctacaatatgctgcttccattcgttttcctggctgtctccctagataaattaactagcatgtcaacagcttagagggcctttctttggtcaaagaaagtacccttcacctatcactttccatcatattactctgtacttagtaaaattagaatttaaggttcatgacaccagagacattttacgttttatttattactgtatccatgtgacctacagtacagaatagaccttagtaagcatcaaatatttattcaatgaataagtgacaaaaacttaatttattagaaatttttatagatattttcgcaaggaaattacatgatcatggttattttaggaagttacaaaagctgtagtgttcagaatatattacaggatacagaaattgtgtttggactcattaaacattattgcaataatcagagcttcaagagttgacagtcctatatggtgtcaacctctaaagcatgaaagaaaatatagaagggatacatttccaagaaaggcatgacggaccatgaaaggcactaattttgtctgtgtagtctcttttaaaaaactaattcttaagtttttactagtggatgagaatttgtagtttttaaacatattcttttctttatatgctctttttaagaaagagcttatatgcttttggtatcaggtgaagaaaagataaggaaagcattttatgtgtgcattaatgatataaaacaaaggcactctatgtcttgttcttacagaaaacctatagagttaaaacaaaatttcaagtctgcatgcctttgctttgaactgtgcagacatcagatgtgcactgcattttagaagagtctgttttttattgaagaggtaaatcagatagatagtttatatgtaggcatgaaactaaaatgtagaggatgtaaaggttattcaaattaaaaggttcaaggaattacaaagctcatttgtagtacaggtgaacagtgaaaacacgaaagtccataaacaaagttagaaaggggaactgaaaaaaaaaaggtttttaagagaggttttggagtgtcctgatggttggtaaatagggtcactcaagaaagagtggcataagtgactacactggaaagcaaaatagcaaagttcagttagataattattactaaccagaaatttgtggtagccaaccactcctctttttttttttttttttgtaaagaaatgttgtgtcctatggagagtgataatgagcatggaatccttggaaattatcgagtatctgtttggtcaaagaaataaacaaaatgatccaaaaaagaagtggaggatccagaagactcaatatgtcagaagtcctagagaacatgacgtcagggtgccctgtcaaacagcatagggggcatttttctcagcctaagtccaggccctgcttgtgtccaatatgattctagtaatgctagaatcatagcattaaaataatattcctaattttaggaaccatctaggaacaagatgactgaagggatgtacacccactgcgctattttcaataatgtcatcctctaccccctggctattaggagtaacatcatagaggggtgtacactttctgcgatattgggagtaatatcctctcccccacggatatcgggaacagttatattaattattaatattaatagatataataattaatagtaatcatagatattaataattacagtagagacagtaaaacagtacggatgaaaaatattaatgttactattaataattaatagcaatatcactattaataataaaataatgatatcagtaattaatgttacttcaatcaatcataagtgatgttggtaataaaaaaataattaatattaagattaataactaatattaaaagtgacattaatattaataattaattttaatcatgcataatcatatcttgaaaataatcattaatgattaataacgttatgctattaatattaccattgattattactaagactgatgtttaataattcataatattattactgctaatactgcagggggtgtacacctacctgtgatattgttcctaatatccagggatcgagagcattgtaatagttttcatatcgcagtaggtgtacactcaccctgtgacaccgatcataatacccagcgggtagagtatgacatgactgccaacatagcaatcaaggtacagccacccggtgatattgctcctaatatacacggaagaagcgtatgatactactcccaatatcgcagggagtgtacacctcttctgtgatattgttcctagtatcccgagggggagaggatgataataattccagcatcgcaggctgtgttcacccagcctgtgaaattgttattaatatcctgaaagggagaggatgatattactccccataatagatagatatgacttcccataatagagcaggaggtgtacacccaccctgtgatattcttcctaatattcagaggccgagaggttgatagtactcccaatattgcaggaagtgtacacccccgtgtgagatggtccttaataatattccaaggcagagggggtgatatgactacatatgtggcagaaagtggacaccccccatggatattgttcacatgatcctggagggaagagcatgatattactttcaatatcgcagaaggtggacacgcccccactgatattgtctctaattgcaacgtgggagaggaggatatgacacgcgatatcccagggagtagaaacacccctgtgacactgttcttaatattcagggaggaagaggatgatattactcccaatacagacgggagtacacccgtctgtgaaacagttcataatctccagagggggagatgatcttactcacaatatggtaaacaggctgagagtccaccgcggatcctaaaaaccagagggggagagggtctggctcttactccccgcatcacggggggtgcctcacccccctgctatgtggatcttcatatccaggggggaagaggggctgtctcttactccccgcatcgcggggggtgcctcacactcctgcgatgtggatcgtcatatccagggggcgagaggggggtgacatgactccccgcgtcgcggggggcgcctatcgccctgcgttgtggattgtcatatcctggggggagaggagggtgatattactccccgcatggggcgggggcgcccgcccccctgagatgtggatcgtaatatccaggggggaggtggggggtgttatgactccccgcatcgcttgggtcgcccgcccccctgcgatgtggaccgtaatatccagggggcgagaggcgggtgatattactcccctatttttcctaggatcctttctatactgccaccctcggttcacaccctgggacattaccttccatattctagcaagatgcggctgctaaagtagcaggggttgtacacccttcaatattattcgcaattttgtaggggaatgttaaacctgatgtcacaggattctgtacgctgtgatgtttttcccaatagcctagctttaccttcataataatgtcacattgtgtgtacaccctgtggtgttattctcctaaggggaggttgcttttattgtcacacggggtatgttccttttgatattattcataatgtcctagagggatgtcactccttatgtcacagggtttgtacaccttgtcaaattactcgtgttatcctcataagatgtcactcctcctatcacagagggtgtacactctgtgatattgtcgtcatattctagggaaatgttacttttaatgtcacagagggtgcacccttgtgaaattattcgttataattttgtggggtgttacccctaatgtcacacggcgtgtacacacagtgatgttacatgcaatatgctatggaaatgttactcgtaattcacaggtcctgtacaccctttaatattcttcgtaatcttctaggaaaacattactgctaatgtcacagggcatgtagaccctgtgataaaattcctaatatcctagcgggagttcactactaatttcacaatgcgtgtacaccctttgatattattcttattgtcctgaagagatgttactactgatgtcccaatgcaggtgcattctctgatcttattcgttatatcctcgggggatgttacttctaatgtcacacggggtgtcctccctgtgttctatttcgtaatatcctagggcaattttacttttaatgacacagggggtgtacacattgtgatgttattcatgatattccagagagatattactcctaatgtcacagggctgtacaccctgtgatagtattcataatttcccaggggtctatactcctattggcacagacgataacaccctgtgacattatttgtaatattctagggagatgatactcctcatgtcacagggggtgtacaccccatgttattattcttactattctagggggatgttactcctaatgtcacagggatgtacaccctgtgatattattcatagtgtaccagagggatattagcactaatgtcacgatgtgtgtacaccctgtgatattatttgtcatatcctaatgtcacaggaggtgtgttccatgtgatattcttcctaacatcctagacggatattgctcctaatgtcacagggtgtgtacaccttgtcacatcattcacgatatcctaaaactatgttaggggtgttcaccctgtgatatttttcatcatagttttgtgggatgttactcctaaagtcacacagggtgtacacagagtcacacactgatatgagttgtaatattctatagacatgctactcgtaaatcacaggggctgtaactcctgtgatattattcctaatattctaggggaatgttgctactattgtcacgggtatgtacaccctgtgatatgactcgtcatatcccagcaggatgttactactaatgtcacaatgcctgtacgccctgtgatattatttgtaatatccttaagagatgttactactaaggtcacaatgcatggacaccctctgatattattcgttatatcctcgggggatgttactcttaatgtcacacggggtgtactccctgtcatattattcgtaatatccaagggggatgttatttttaatgtcaccgggggtgacattatgcattaaaaatgggtattcaacgcctgtgatactattcctaatatcctaggggcatgctcttccgaatgtcacatggagtgtacaccatgtgtgtacacctgctgtgatattattcgtaatatcctaggggaatgttactcctgatgacacaggcagtgtacaccatgtgtgtacccctcctgtgtcattattcataatatccaaaggggatgtttctcttaatgtcacaaagagtgtacaaaacatcacagaaggtgtacacgttgtgacattatctgtaataccctggaaggatgttactcctaatatgtcacaggggtgtacacgctttgatgttatttataatctcatagagagatattacttcaaatatcacagtggatgtatgcacatagtgtataccctgtgatagtattcataatatcctagggagatacaactcctggtatcacagtgcgtgtaccccgtgtgtgtacacccttgatattagtcgtaatatgcagggtaaatattactcctcatatcacacagtgtgcaaccctgtgatatttttcatcatactttagggagatattccttctaatatcacagtgggtgtaccccatgtgtgtatactctgtgacagtatattctatatcctagggaggtattactctaatatcacagtgggtgttcaccctgtgatatcattcttatttgaccttgctgccttttttaacccacactacaaaaggaatggaacagataagaagatatcaagattagaccgtgctgctgtgcggccgccgcaggacacttttaatatccctgtttctcaggctgtagatgaaggggttcagcatgggggtgaccaccgtgtacatcactgaggccactgcagcctttctcggggaagatgacacatctgaactgaggtaccctccaacgcctgttccataaaatcagcaaaccactgacaggtgagacacacaggtggagaaggccttatacttcccaccagatgatgaaaccctcagaatggagaaaacgattttatagtaagagaaaagggtccccaagatgggaagaaaaccaaatatggcagcagggaaatacaggattatgttattggtgaaggtgtcacaacatgcaagatgggggagttgagaagggtcacagaagaaattaggaatttccacatccttgaagcaggtcatttgtaaggcaatcaagttgcgcagctggacgtctaaaagactgagagaaaaaaaaaaagacaacaaaactagaaagccacagaaacacgggttcatgatggctgaatgatatagagggtgacagatggctacaaaccggtcataggccatcacactcaggaacatgtctctcttccatgcctccaaaaatggcaaagagagacatctgagtcaggcagcctgcataggagatgactctgctgtgagactggatgtccacagtcatcttggggaccgtggtggaggtgaaaccgatgtcaggcaaggacaggttggagaagaagatgtacatgggggtgtggaggtgggagtcagggctgacggccaggatgatgagcaggttccccagcaccgtgaccaggcacatggacaggaacagcccagcgaggaccggctgtcattctggatcctctgaggttctaggaggaggaatatagagacatctgttagattctgtgggtctgtagagattggacaccttttgcctagaaaagagggttgagaaatcagaaacaagtaaaccaacacccagcatcgtgtctgcattttggatagaagcaattcacaagtaatgttttcagatttcagagcaatccacactcagcaatattttgcagttctgacaaactcaattgtcttctaatgctttcatcattgatttctgtgttcttcacttcttgctgtacacacctgcctcagagacactagattcaagaatgttccaagaaccagatcatcatatataagaaattcctaactgctagaaaagacagcctatctttaccaaaggaaactatgtaataaaaccattctcttcactataagaaaaaggttatcctagttaaaggaaattaagaactcaactattttattttattcgaatagattgatacaaattcccttgatttagaacatctgtaaacactgtataactgctgagaccatgccatctggaaatgaaattaaagttgatagttcataagcagaaaatagttccacaggccagttaggtcctagtgatttcctcattaagttttctgacttttctccttcaagagagtaattgcttactcaaatcggtgggtcttgttttaaaattcatggaagctataactcctgtccttagcttcggtggacttagaattttcatcagaaagtttggccagacgcggtggctcacgcctgtgatcccagcactttgggaggccgaggagggcggatcacgaggtcaggagatcaagaccatcccggccaacatggtgaaaccccgcctctactgaaactacaaaaacttctcccagtctggcggcgcgcgcctgtagtcccagctactcgggaggcagaggcaggagaatggcttgaacctgggaggcagaggctacagtgagccgagatcacaccactgcactccagcctgggcaacaagagcaaaactccgtctcaaaaaacaaaaaactaaaaacacatgctctgtcacactgacgtcacactgatgacagccaatttttgtgaaccaaggaagtgtcaattcaataattcacagagatgtttacttttgctatctcctatgtgccaagcaagatacaggctctggggaatcagaaacaaaagagactcacttgttcctctcacaatactcagtacttactgagataaggacaaaagaaaatgtcctgtctggaatgcagggaaaccagaacttcaggtcaggggatatttacgttgaaccgtatggaatttaagctgaaaatattaacgaatgtatctaaaattcactttgccttgactttacgcatccatcacacagagatcacgcagcgggcacccacgatcggtttaatcatcgctcgcttccattggatcaactagaaatcaactcagatgagagtgctgagtctcagaggatggacgtctcaccccttgccatacagagaagtagaaagggtggtattgaaaattaatggccagactctaagtcccgggcgctatacttgatggtccccaaccctcaaaatgttgtgcgttcttttttgtttttgtttttgctttttttttttttttttttcagacggagtctcgttctgttgcccaggctggagtgcagtggagtcatcttggctcactgcaacctccgcgtcccaggttcaagctattctcttgcctcagcctgccgagtagctgagattacaggagcccgccaccacgcccggctcatttttttctcttttttaggagagacggggtttcaccatattggcccggctggtctcgaacacctgaccttgtgattcgcctgcctcagcctcccaaagtgctgggattacaggcgtgagccatcgcgcccagcttccaaaagttttcaacagagctcagaggtcttaaccacaggcacatctgaggagcatttttgaaatggtttccagcttcctcaataggaacggaagccaaaccccgaatttatgactcctttgaggaagttgagagctgtaaggaaagccaggaacaggggcaagggagagatgcatcccgaatgatcctgtgccaattctttctggaatctttgatgtgatctcagctgccctttccatacttgacacagtgattgtggcacccactggtctagctgtggtctacaaggaacccccaaagggaagggcacagtgagcaggggcattgtcctgagtgacaaggattggagggggcagggtggatgcagggagaggactggccagatgccatgtgtctggccttagactgcctggttcaaattgggcttcaccctttttgacttcatgatctggtacaagttatatgaaaatgtgttgctccttttctagtctgtaaaataatcctgaaatgtgcactaataactgggagactacgcagatgaaatgaaacaagctgcagagagcacagagctcagagcctggcctttaggaagccctcagtaagggttcatgatgtcgtggtgtctgtcaccatcctctttatcctcatcatcaccttcatcatctttttattgttctgagggaatagtttagaggggctcattccctgctatcgtgggtgagacgtctatgaaaaggacaaccagtgggggagggaagcaaaattttgaagaagattcctgagagagaccccccaccacaaccaagaacagaaactccacagtctgctgagctgacagttagcacattggtctcctcccatctgcccacggcactctcctgtttgtcctgaggatgaggaaacaaacaaggctcccgaccgtccctcagcactcactgcactgcccttcccctctgctgggccatgaccacggagaacaggtccactgtcctccctgcgtggtgcacattggaggctcagactccatcctcaaggctggccagaagacagggtgagacatgagcctcctgatacaggtgacggttgtggagcccacaggactgcaacctcacactgcagggctggaggcacagactgagtatttactattctatggcctggggggctaaaggcacagagctcctcattagccagtcacccaagttccccaagctctaaggatttcctcatcatcatgcaggaagaagaaaagtgagtgtccatagaagctttggggctcttcctctaatcaggagagagcttgtgtgtattattcgcttctttcttttctttcacaagatccaagtgctttaattttcaccttttattatgggaaagtataccacgtataaatgttataaattataaatatagattatttcatatagaatggccagtataaacatttacaatttccactatttttcagtttacagtttaatcacattaggtacattcacattgtttagcaaccatcaccgccatcatctccagaacagttttatccttgaaaatggaaattgcacccattaaccaacctctccattcctctctctctcgcccacccctgggggccaccattctattttgtaactctataagtttaactactctagacacgtgatataagtggaatcacatggtgtataatttttttggtttgtttgttttggagacagagtctttctctgtcgcccaggctggagtacagtggcgtggtctcggctgaccttaacttccacatggtgggttcaagcgattcttgtgtctcagtatcccgagtagctgggattacaggcgtgtgccaccacgcccagctaatttttgtatttttaatagagatgagctttcaccatattggccaggctggtctcgaactcctgaccttaagtaatccacctgcctcagcctcccaaagtgctggggttacaggtgcgagccactgagcctggtcgtgtttatccttttgggatttatttatttcactgacgagaatgtcttcaaggttcatctgtgttgcagcctgtgtcagaagtgcctgtctggttgtttgggtgtgtttttttttgttttttttttttttgttttggttttgttttgtatttacatggagtctcactctgtcgcacaggctggagtgcagtggcacaatctgggctcactgcaacctccgtctcccgggttccagcgattcttgtgcctcagcctcccgagtagctgggactataggcacacaccaccacgctcctctaatgttttgcattttcagtagagacagggtttcaccaagatggccaggctggtcttgaattcctggcctcaggcgatccacccacctgggtcttccaagatgctgggattacaggcgtgagccaccgcaccggccagaagtgcctgcctttttaaggctgaatagtcttccatcgcaagaatgaactgcagtgtgccttgtaattcatctgtccacgaacccttgggctgcttccacattttggctgttgtgagtaatgctgctatgaatttgggtgtacaaatctctcttccactcctggcttctaattctttttggcaggtacccacagtgcaactgcgggaacatctgataatcctgtttctactttttccagtacacgccatagtagtttccctgttccttcatggttttacattccctccaatcagattccagcattcctacttccctctagtttcaccaatgcttctttgtttatcatatccatccaaatgtgtggtatcacattcttggtttgatttgcgcttccctatgattagtgattttgaacatcattttagatgcttattggccattgctgtgtcttctttagggacacgtctactcgagtcttctgaccgttgttcatgggatgctttgggtttcttgttgttcagttctagctgttctttgtatatgacgcatatcagcctcttttcagagatatgatttttgaatatttttcctaatccatgggttatcttttcactcagttcacagtgtttgctgatgcacaaaagtgtctgtcatttagatgtcatccaaggaatctaattttcttttgttgcctatgcttttggtgtcatatcccagaaagcattgcccaatctgatgtcatgaaagtgtggccaatgttttctttgaggcatattatactttcagcactcggggttaggtctttgatccagtttgtgttcatttttgcacctggtgtgacatagagtccaccttcattcttctgcatgtggaaatcaagtttctccaacaccatttcttgaaaaggctgcttttccaccaatggactttcttagcactcatgttaaaaatcatttgaacacatagatgagaagttatttctgggctcaaaaacaaacaaacaaacaacaacagacaacagataaggatgcagcatgggccaggcgcggttgctcacgcctgtaatccaagcactttgggaggccgaggagggcggatcacctgaggtcaggagttcaagaccagcctgacagataggaagaaaccccccatctctactacaaatacaacattagctgggcgtgctggggcatgcctgtaatcccagctgctcgggagatggaggcaggagaaaagcttgaacccaggaggcagaggttgcagtgagccaagattgcaccattacactccagcctgggcaaacaagagcaaaactctgtctcaaaacaaaaaaccaaaaacgaaaaatccagcatgatttcgagagcagaaagagaatagctgaaaaaccagcataatgagaaagttaggaagcttcttaccaaagcatctggaaatatgccagaaattcttgtgaactaaaattttcatactgtactatcaaacactagaactcacttattccatctttctgtattttgggaccccattatccacttctcttcattccccatcccacccgttttcttcctagcgtctgctaaccacctttatactttccaccttcctgagattccttttgtgtgtaggtgtgtgatggagtctctttctgttgcccaggttggagtatacaggcacaatccgggctcactgcaacctccgcctcccgagttcaagtgcttcttgggcctcagccctccgagtagctgagactacaggcatgggtcaccacgcccggctaattgtttgtgttttcagtagagtcggggtttcaccatgttggccaggtgggtctcgaactcctggcctcaagtgatccgtgtgactcggcctcccacagtgctgggattacaggcctgagccaccacacctggccaagattttcttttttgttcctacatagaagtgaggatatgaaatatttgtcactctctgcctggcttatttcacttaatatacagacctgcaatctcatccattttgtctgcagtggagaggattttgtttattcctttttaggctgaataatgcttcattgggtgtgtataccacagtttctcaattgaaacaaatttctaaagagcaaatatttttaacgtgtctcggaatgtgaaacttcagggatactgtgcccgttttattcttttctatttcccatcttatgtatatgcaagtgtatcacaaagcagcaatcaaagtgtgtataaatctataatttcaacaaatgtaaaatgaaaatgctaagtggtggctgggcgtggtcgctcacacctgtaacacgccagaacgttgggaggcggaaccgggcggatcacctgaggtcgggagttcaagaccagcctgaccaatatggagaaccactgtctgtactaaaaacactgaaaaaaaaaattagccaggcatggtagtgcatgcctgtaatcccagctacttggaaggctgagacaggagaatcgcttgaattcaggaggcagaggttgcagtgagccgagatcgtgcactccagcctgggcaacaagagtgaaactctgcctcaaaaagaaaaaaaaaagaaaaagaaaaaaatagaaaatgctaaatggtaagaaacaacagcataatagacatttgtatggtgttgatggacaatgcatttgaagataatatttgaagaaatcatattacaattaacttctgttcttactcattggagcttgatgccttaaaaacttcgtcattgcaaccacctctgatgctttaaaaaaaaaaaaaaaaatccacatactcacacaggtgccgggaaatcagaatctcaggtaatgagacccaggcctcatcatttttaagctccccaggtgatttgactcaaagccaagattgaggactggtcacatggatctctacacataacctgcctaaatagattctctagaagcagtttataaagaaattacatgtgaactctggaagaggatatgaattagatgtacagcatgtcctcacttaacatctttgaaagtctcttgaaaacttcaccttgaagcaaaattaggtatagtgaaaccacttattcctcaccaacattataactacacaactttgaatacaccaatggtgttggaggacctgctgtacattgtttccataaagtcaactttcagggaattccaaaatgaagtgaggacttcacgtatataaaaagatggttgtgattccacctggatgacagggttattgctcagaaactaaaggaggccgcctaggtatagaggattcagtcatgaggtttctgctaaacaaaggatcccagaatactcacccattccagttaaaggcataacgaagaaaacaatattcacataggaaatgcggaaaggaataaaagccatcaagccacaaaaataatgtgactaaggagcaggatttgcagatgcagggatttaatgtggttgccctttcttacccacacaagaaaaaggatggaacagatcatgagattcgactgttctgctgcgcagcctccagagggcgctttgaatgtctctgtttctcaggctatagatgaaagggttcagcatgggggtgaccacagcgtacatcactgacgccaccacaccactcctggggggtggtgacacagctgaagtcaggtacacgccaatgcctgttccataaaataagcaaacaactgccaggtgagagccacaggtggagaaggctttatacttcccatctgacgatgaaatccttagaatagaggggacaattttatagtaagacaaaaggatccttgaaatgggaagaaaaccaaacatagtactatcgaaatataagaatatgctattgatgacgctgtcagaacaggcaaggttgagaagctgagatggctcacagacaaaattagagatttccacattcttgaagaaggtgaattgtaacacaatctaactgtgcagctgggaatccaacaggctaaggaaaaaggacaccaaaactaagaagacagagaggtgaggattcacgatgactgggtagtgcagagggcgacagatggctacaaagcagtcataggccatcgcagtcaggagcatgtcttctatacatgcaaaaaggaccaagaaagacatccgtgtcaggcagcccgcataagagatgactctgctatgagactgcatgtccacaatcatcttgggaaccatggccgaggtgaaaccgatgtcagcccagcacaggttggagaggaagaagtacatgggggtgtggaggtgggagtcagagctgacagccaggatgatgagcaggttcctcagcaccatgaccagatacatggaccgggacaacccagcgaggacgggctgcagttctggatcctctgagagtcccaggaggaggaattctcagacacctgtgagattccatggctctgtgtgacttggacacctagggaagaaaagaggatttgaaaaataaaagataaaaaccagcccttaatgctgtgtgtatattttgtgaatacacacacaaaataatgctgtgtgtatattttgtgaatacacacacaaaataatgctgtgtgtatattttgttcctagatggttccttaaagtaatggcggctagatgaggtggctcaagcctgtaatcctagcactttggggggccgaggcatttggatcacgaggtcaggagtttgatactagcctggccaacatggtgaaaccctgtctctattaaaatacaaaaattagccgggtgtggtggtgggtgcgtgtaatcctagctactcaaggggctgaggtaggagaatcacttgaatccaggaggtggaggttgtggtgagccaacatcaagccactgtactccagcctgggcaagagagtgagactctgtctcagaaaaaaaaaaaaaaaaaaaaaaaaaaaggtaatggcaaaattgcaataacttttgcaccaaactaatacaaactggtgttatacaaacttttcattcctaaaataaatcccatttgataattgtgtataagcctttttatattttgctggatccaatttgctgggatttttttttacaatttttttcatcctttttttattattatacttcaagttctgagatacatgtgcagaacgtgtcggtttgttacataggtatacacgtgccatgttggtctgctgcactcatcaacccatcatctacattaagtatttcccttaatgctatccctcctctagctccccaccccccgacaggccctggtgtgtgatgttgccctcccggtgttcatgtgttctcattgttcaactgtcacttatgagtgagaacatgcagtgtttggttttctgttcttgtgttagtttgctgagaatgatggtttccagcatcatccatgtccctgcaaaggacatgaactcatccttttttatggctgcatagtattccatggtgtgtatgtgccacattttctttatccagtctatcactgatggacatttgggttggttccaagtctttgctattgtgaacagtactgcaataaacatctgtgtgcatgtgtctttatagtagaataatttatacctttgggtgtatacccagtaatggcattgctgggtcaaatggtatttctggttctagatccttgaggaattgccacactgtcttccacaatagttgaactaatttacactcccaccaacagtataaaagccttcctatttctccacattctctccagcatctgttttttcctgactttttaacaatcgccattctaactggcttgaggttgtatctcattgtggttttgattttcatttctctaatgatcagtgatgatgagctttttttcatgtttttttgaccacataaatgtcttcttttgagaagtgcttgtttatatcctttgcccactttttgatggggttggttttttcttgtaaatttgttttagttccttgtagattctggatattagccctttgtcagatggatagattgcaaaaatattctcccgttctgtaggctgcctgttcattctgatgatagtttcccttgctgtgcagaaactccttagtttaattagatcccatttgtctattttggcttttgttgccattgcttttggtgttttattcatgaagtctttgcccatgcctatatcctgaatggtattacctacgttttcttctagggtttttatggtttttaggtcttaagtttaagtctttaatccatcttgagttaatttttgtataggcttaaggaaggggtccagtttctgttttctgcataaggctagccagttttcccaacaccatttattaaatgtggaatcctttccccatttcttgtttttgtcaggtttgtcgaaaatcagatggttgtagatgtgtggcattatttctgaggcctctgttctgtgacattggcctgtatatctgttttggtaccattaccatgctgttttggtcactgtagccttgtagtatagtttaaagtcaggtagagtgatgcctccagctttgttctttttgcttaggatggtcttggctgtacaggctcttttttggttcatatgaaatttaaagtagtttttttctaattctgtgaagatactcaatggtagcttgatggggatagcattgaatgtataaattactttgggcactatggccattttcatgatattgattcttcctatccatgagcatggaatgttcttccatttgtttgtgtcctcttttattcccttgagcagtggtttgtagttctccttgaagaagtccttcacatcccttgtaagttgtattcctaggtatgttattctctttgtagcaactgtgaatgggagttcactcatgatttgcctctctgtctattattggtatataagcatgcttgtgatttttgcacattgattttgtatcctgagactttgctgaagttgcttatgagcttaaggagattttgggctgagatgctggggttttctaaatataaaatcatgtcatctgcagacagatacaatttgacttcctctcttcctatttgaataccctttatttctttctcctgcctgattgttctggccagaacttccaatactatgttgaataggagtggtgagaaagggcatctttgtcttgtgccggttttcaaaaggaatgcttccagattttgcccattcagtatgatattgcctgtaggtttgtcataaatagctcttattattttgaaatatgttttatcaatacctagtttattgagagttattagcatgaaggggtgttgaattttatcaaaggcctttattgcatctattgagataatcatgtggttttttgtcattggttctctttatgtgatggattactttttttgatttgtgtatgttgaaccagacttgcatcccagggatgaatccgacttgatcgtggtggataagctttttgatgtgttgctgattcagtttgccagtattttatcaaggatttttgaattgatgttcatcagggatattggcctgaaattttctttttttgttatgtcttgtcaggttttggtatcaggatgatgctggcctcacaaaatgagttagggaggagtctctctttttctactgtttggaatagtttcagaagaaatggtaccagctcctctttgtacctctgatagaatttgtgaatctctctggtcctgggctttgtttggttggtaggatattagttattgcctcaatttcagaactttttatcggtctattcagggatttgacttcttcctggtttagatttggaagagtgtatgtgtcctgaaatttatccatttcttctagattttgtaatttagatgaatagaggtgtttatagtattctctgatggtagtttgtatctctgggggatcagtggtgatattccctttatcattttttattgtgtctatttgattcttctctcttttctcttttcttctttattagtcgggctagtggtctattttgttgattattttaaaaaacagctcttggatttatttttttaatggtttttcatgtctctatctgcttcagttctgctctgatcttagttatttcttgtcttctgctagattttgaatttgtttgctcttgcttctctagttcttttaattgtgatgttagggtgttgattttagatctttcctgctttctgatgtgggcatttagtgctataaatttccctctaaaccctgctttagctgtgtcccagagattctggtacattgtgtctttgttctcattgttttcaaagaacttgtttatttctgccttaattttattattcaggagcccagtgatcattcaggagcaggtcgttcagtttccatgtaattgtgtggttttgagtgagtttcttaatcttgagttctaatttgattgcactgtggtctgagagactgttatgatttctgttcttttgcatttgctgaggagtgttttacttccacgtatgtggtcaattttagaataagtgtgacgtggtgctgaaaagaatgtatattctgttgatttggggaggagagttctgtagatgtctgttaggtccacttggtccagaactgagttcaagtcctgaatatccttgttaattttctgtgttgttgatctgtctaatattgatggttagtttcatagttactaatctcatctctgtacttgtataagtctcttcagattttctgtttcttcatgagtttttttccagtagtttctgtctttctggaaatacgtcccttccatttattttcattgttgttgtcggtgtagagtgattataatattgccttctgtaatcccttctgtttctctaatgtcagtagtgatactccttttgttactaattttggtaatttgatatttctctgctgttttcttgttagtttagccaaaattttgttaattttgttgatcttgacaaaaaatggtcattgggctttgttgattttctctattgttattcaattctctatttcatgtatttatactatcatctttaatatcttcttccttctgattttttaggttcattttgctctacatgtccagactcttaaagaaaaagaattatacatatggtcatacacatgaaatctttccttttatttttatgtagaaatttacagacacatattttcctcctatgagtgctatagctgtaacctttaagttttggtatgctgtgtcgcattttcaatcatcacaaatcctaaatttctttttgttattgatttatatttccattatatttggtcacaaaatatagttgtataatttcaaatcttttaaattcattagccctgttttatggcctaccatatcctgtctcttggagaccattcaatgatagcttcagaagagtatgtattgtatttgggtagagcattctatacatgactgtcagtgaagtattaaaaacagtattaaaagtggtacattgaaatcttcactattattcctaaattgaatatttcttcctggaattcaatcaattattgcattatgttttttgaaaccctgtttttaggtgaatatatgttcaatatgtttatagttattaaattttcttgatgaattaaccatttaatcattatacagtgtccctgtttatctttaataacatttttaagtctgtcatttcagatcatgttacagccatttcagctttcttatggttactctttgaacgatattatcttttttcacacttttattctccatgtatttgaaaatacaaactgacaatatatagttgcattatcttttttatccagtctgacaatcttttttgattaaattgttttctccattcacgttttatgttgtaattgatttatttgcatttgtcattttactatttgcttctattatgtcacggcttttttcgttcctccatttcttcttcactgatttttttgcctgagtattttatgacgacatattttatttctttaatttttttaactatatttttagttattttattagtagttattatagggcttaacatataaagcagttcttcagaattagctaaagatttatactaactcaattccacaaaagacatagatgttttactttatatatctctattttcttttctccccttttttgaaaactttgtcatacatattacatatatgcatcataatccccaaaatttaatgttgtagttattactttatataattttaggaattttaaagacactgagagatggaagaacaaacatactattagattttgtcctattaattttttcaactctgttgtcaaatatgttacatttttattgtcataagctcaatgatttattgatatatatataggtttacatgattgctttttatgttagttaaagaagaaagaatacaaaatatgcatttatatatttaattttgccctgaagaacagactttcattctgaagaaattcccgaacaatttcttataaggttgtcttcttgccactaattatctcagtttttatctgggaatatctttatttcccattcatttttgaaagacaatttttgctggtgtaatattattggttgatttttatgtttgctttattttctcttagtcctctgttcaattattttctcacttgctcaggtctccattgcttgcgatgatattaatgaaacagctgctgatcttattgaagttaccttgtgcgtaagtcattttttcttgttgttttcaagaatttctccttgtttttttgacattattttatgtgatgtctttgggtgttgatctcttttgtgttgatcttactgctagtttattgtgcttcttgaatgtgtagattgatttttttcatacagtttagaagttttcagttataattttcttattttttttctatttctttctcctcttcttctgctatgcctattacacatatattgatgtggttaaagtgttacacattttgttgaggctttgttcattatatttatttctctcttcttgctgttattcagattgcataatagtttttgatctatattcaacttagcggatttttgactcctgccagattgcaggtacagttgagccgactaggtaattttttaataaaattattatacttttcaattacagaatttccagttctttaaaaataacttttttgatgttctctgcttgatgagacattgccagaaattcctttacttcctttacttctttatttttcctttttttttacttctttaaacatgatttttctttagttattgaacatatttataatagctgctttgaagtatttgtgtaagtccagcacctatgccctctcacaggcatcttctgttgcttgaggtattttttgttgtggtggtggtggtgatttgttattgtttttgtttgtttattgttttttttcctgtttatggctcacactttcttatttctttgcatatccatatatttttcctgaaatctgtaaattttagataatatattttaatacttctagatactgattttcataccttcaaactttattgttaatgtttaaaaatgcatttccttcgtaatttaactggtttattttagagaaggcaatttttcccctgcagtgtgaaacatctgatgttgcttctccgaggatagcgttgaacatgtgcacagttgccctgagatgacttgttagcagggctctctttgactttatttttctctgatttctctgttaagccatcttttccactggtcttacacacagctgttaggctccactaattgccagcttattgttctattttttatcaatgcactggggtataaatttctccacagtctgacccaattaaagtcatactacttttcaggaataatttttgagaataatctttaaagtttgctttgaccccagaaggtctcctcttaggaatacctttccctggttctgtttggtaaactaacaagactacagtttagcttattgctgtcatgaaactacccatattttcttatgtccatctcacaaaaatatccattgtttttgatatcatcttaaggcataaacttcctaacactcctcttcaaataaagtcaatacatttcaggaaggcttccgagctttcaattcttatggcctttctcttattggaaaaatctccaagccactgctcctagacagggggcaggcatagtggcctagctttcttgaagtgacattcctgtttcatgagtagggtgctgagcaggggagatattctctggtagtattgcctttctctccctacgttgaactctacattaatgaacaagctttggtaagaaaattattgctccagttctcttggactgtcatgcctggcacagaaattcttacctaccagggaggctaagtgaaaaaagagatcatcatacctctcagctgcactatcccggaatttagcctttgccatgtgaactgcagcagataataaatatttgatgtctgccccttccaggaagacactgtagcccttgacttagagctcagggcagaaatatcttcatctccttggctgtattcacttgaagttgactatctttcatgcagagctaggcaatgggaagtgagttgcagctcaataacaaaagttccaattaacttattttcagtacattttcttgaataaatacttttttgtttggtgtatacactaaggacagttttcagagagttttactgcttggttttacctttgtctttataatattaacagttgtggtcatgtcactggagaccaggttcatagtactcctcattctgccatgcaggaaatctttctagggtttattttagtgtgctaagataatgctcaaaggtaagggctaatgaccagcaaacccacctttcttcattgttcttttactgtattattagatctagttaaaattaaattcataatatttaagtaatctgtataaagcactttatactacagattgaatttccatagtgacattgtctattttacattatgactctcaattcctagatgaaggaactgaggcccaggtaagttttatgagttgctcataatcattcaccagtagtagttggtcagaaacttccatgagattccttcattcctccagtgccaatggcagtgaatatgtcacggagccagtactagggttgggcaagacaagtgaatgaggcatttgctttgggcacaaaatttaatgatgtactttaaacaggaggtacatgagagtcctttaaaaaaaatggggtgctaaattcaattatcaatgtaaatacttaatgtagtatttttaaaagtaaaaatcaataaaagtatccatgatgaacaaatatcaaaattttaagtgaagatgcattctttttttattattatgattttactttaagttctgggatatttacgaagaaggtgcaggtttgttacataggtatacatgtgccatggtggtttgctgtacctatcaacccgtcatccaggttttaagcgccacatgcattaggtgtttgtcctaatgctctccctccccttgcaccccacaccctgacaggccccggtgtgtgctgtcccccctccctgtgtctatgtgttttcattgttcaactccctcttgtgagtaagaacttgtggggtttggttttctcttcctgtgttagtttgctgagaatgatggtctctagcttcatccatgtcactgcaaggataggatctcattctttttttatggctgcatagtattccatggtgtatatttaccacattttctttatctcgcctatcattgatgagcatttgggttggttccatgtctttgcaattgtaatagtgtggcaataaacacacagaagacacatctttttttccttttgccccaggctactgttatgtttcttcatggcaatggatgtgcggattaacacttggactctagagttgcaaagcttagacaccaattctggcatgtattcctggtatagtaggcacatcacttcacatctataagtctaaattttttcatctataaaatgtttgtaacattaatacctacttgataaggtttatgacagaattaaagagacaaagtgtggggcatgtgttttggcaatttataaacattcaatacatgcatatagttttagctgttatttatggttatatttaaatatggccatatgtaaaatatataaatatatgtatacatgcaaacacactcattcacacaatctccctgaaaacatgaaaatccaacagtgaagcagtgtgtattcaatctactgcagttaggagaagaacacctttacataatcttggaaatgtttcaaaataaaaaaaggttaggaaaaagtgtttactgggttttagattcaagagtggatgattttaaggagagtcttagaggggaaaacaattatttgagatggtcagaatttggcataatatctttggattgaagataaaagagaggagagggcctcgaactcagtcttggtgagcacatgtatctgacaggtaagctgtttgttgttttacttgtcttctagaaatagttatttcctggagcaagttgataagttatttctaattattagcattgtttaacacagagccggaaaatactttgtggtctacatttttatctcacacgctacatgtatttacacacatacatttatgtgcatgtgtatgtatagtatattatacacacacaaataagaaatagatcaacttttcagttgcaccataaagtaatttgcatagttactaaaatccctgctgttctaggttaattgaaaatcaccatcctattgctagggactctgttgacaatcaccactccagtcttctgtggattggatttccacagattcagcaattccagtgcctagctagtgctgactctttagataggatgacctttatcataccttgttaattttaacctaatttcagctcactataatctatgataactgagatatattctttaagttaataaagaaatgtgtatccaaaacttagcaaaaaacaactggccatgctggaaacacaggttagtttacagagtcactaatgattgtttatgattatgctttttctagttagtgagtgtattttcagaaagctactacttaagtgaaatttgattgtgttatttgaatgtattacttataattatcatcacttcagtttttttgtcttttaaaaatactggcagccatctgactgaaacagaaggcaagggacactgtggcccaagcccaagcatggacccaggagatcatgtttcagtacctcagagagcttattttcaacaggaattaatatgcatcttgttgctgttcagctgtagaattatagggttaaaatatattatgatttttggtattctatgctttgcaataatgattttcattctaaaattgtttattgttacgttattaaaactacaatacaatgaagcaaataagttcaattaaaatttagtaaacagttcttttttgtttttatggttaacctgaaaggcatggaaaagattacaaaagttcttacattactgtgcctttcttttaaagttgcaattcataccatgcccataatttgtaactataggtacgtggaggtacataaatttttaccaaatcacataatatagaaaaagtaagaaacagatatctcaacatgactaaaagaaaacgcacttaaagtaagccaggtaaaatgtccttttagttttgccttttctgtttgtggtcatgctgagaatagtgatatcatattgacaacaggaaaagcacaaatataaaaatttctagaagacagatgaatttattattctgttattcctagataacaattatcaaaccatgcaggtacactcaattatcagttttcacaattgatagaggtgtttcatagaccaatgtcctttcctaatgaaatactaaataataaaaactaattgtattcaacctagaaagtaattcttaattatcaaaaggaaggtactctctgtgcaattgcgatgtttactaatagtatattgctttatatttgtatactctacaattgtatactcatatttctgtaggttgaaaaaacaaaattattttattcttatgttaaactaatgagaatacatagcaatattgaagaacaaagtgtgaataaaacaaaaaaagaaataaggagaaaatctgtgcaagagaaaaggaaatgtcaataggcaaataaaatttactctagaatcttacttacaatttcttacccactgttattgttaattctatagaccaaacctcttccacagtgtcaaaatttgacactttgtaaagattataactcaataacctatttatgaactcctgaatctgtatagtgtttcttctgacaaccacctattccatttgatttctggccttttgacttaattcaaacctattcctggttttattgagatttctgtcctattttcatgctcatatgtgcaccaggcttttaacttattacagcttcccccaaatcccaccttcatctgtttgctgactgttcacgattctgagtctttttgcctcatggacaaaacccaatggaaatatcattttaatatatgataactatttaaaggtttgctttctcataactatctttagctaatatgaataaaatttcatatataaatgatcatatctttaagaatgtacatgtcattatttgacattatgagtccaaattcctaaattatgcacaaggtatccattcacttaaatatatatagtcactattactatgtggatttactgaaatatagtttgtagtctaaaatttggatgaaatttagcttttagaaaaatgtgtagatccttgcaaacttttaaaaccttacagtgggtattactgtttatctcatctgcctcaataaagaatagtgacaaataaaaataagatcctcagccccccaacagactgaacagatcctcctcttcatcaaggggtatcagaatgcaaaacaaagcattctgagattcaccaagacaatgaaaagttataggctgtcttgaataaaagttataagatgttagagctaaaccaataatggccctcaggaaatacaaatttttctggttagattggaaggcaaaagcaagctggtagggcctttaaagctgggctttatcctattataatggagatcttacttaaatgtaaaaactaggtagtggtatgaaaacagaactggatttaaatggaaagcagaattgaacagagagaatttaaaaggaaattttaacagattactgaaaatgaaagaatgaattttacacaagccgattttagggaatacaaagttcatatttcagaatgtggcaaagcacatagataccctatgacttcatttatttgacccagcaacaaaaaatgaaaagaaaaaaaatgaagagtgattgctagagctaagaatggggaaaataactaaatacaaagagatagcaggggaacttttgggggtaatgggaaaatcctacaacttgagtttgacagaaatgtcaaacttcatagaactatacatcttaaaagagtaagtcttactgtatctaaattatgcattaataaatcttacttttaaaattataaaagaaaggatagtgactagatattgaaccctgagtaatgatttgcatgccgaaatgtttaaggacaaggtatactgatatctgcatcatagcttaaaatgcattgaaagggtaaaatgatttgacagagggctggaggataaagacatgacagatagacatgtaataaagcaaacatagcataatgtcagttgtttagaactttttccaaattttctttttatttttttctgagacagtctcactctgtcacccaggctggtatcaaactcctgacctcaagtgatccacctgcctcagcctcccaaaatgttggaattacaggcatgaaccatcgcgcctggtccctaaaattttctttacatctgaaaattctcataacaaaataacaagaaaaattatagagacacactcatgactgcacacatacataatttatgcatgcatgcaagaacaggtttcaaagtacaacatcatcacacaccaaaatattgacagcgttcactcctatgtaatctgtacactggattgataatagatgggaaatgcgtggtactttgacttttttccctataaaacttcggattgtttaatttaactataaaactctaatttttattaattttaattatagtacaataaagtaaatgaagatgatatattgctaattttgtaagtatattggaagttgtaggctggagaaacagagaccttcaagcatgtgaataaaatctgagagaattttaagacatatcctaatggattaacagagaattaaaggtggattaacagagaattaaaggtgtattaacataggtctccgtgagaggagtcacaatcaagctcttgagctctctctttaattgtcccaaactcaccttcaaaactgttttattgacacctccgcattgataagattttgcttgctcatgaatagaactatcattggaagcagataagtgcatggttgtggctttctcccccatcttcaaagttgttctctatgactgaatcagtaagatgactgttaccctccatggcttttttcctcacataaatattctgttataccatgatgccaaataccaatttggaatgccatttatctgtattaataaatcaggacacgagtgtggaaggaactatgaagatcattacaaaaatttcagtgcaaattttggcatcagcctaaaatactctatcaaagcttaacaatttgcatgggagtgttggaaccaggcccagaaataataagattgatgtctaataagtttggctctgtgttcccacccaaatctcatcttgaattggaatccccacatgtcgagggagggaagtgattggatcatggcaacagtttcccccatgctgttctcctgatagtgagctagttcttacgagatgtgatggttttataaacatctggcatttcccgtttgcacttctctcttctgccaccacgtgaagaaggttcttgcttacccttcaccttcagccataattgtaggttttctgaggcctccccagccatgtggagctatgagtcaattaaacctctttcctttataaattacccagtcttgggtatttctttatagcaatgtgaaaatagacaaatacaatacttttaaaaaatcaattatgtttaacacttgctaagatatctattaagaagtagagataactccgccaatgcaagagtcatatccctggcatctctggctttactacatgagatagcacctcaatatcaatgagttgtgttaatttcaaaacatatattaagaatcattattgtttttcaactttgggtagttacttagtatgttatattgataaattcatcaaatttaaaagattagactgaggtaacaataggcagggctagcctgaccaaaatgacaaattaaaggtaaaacttattttggtcttatttcacttagatatcaaagtgtgtaggtgtgtggaggaatgggggattagttcttgacatctgattgctctatgaagtcttcccaaatctgtataagaacagaactgagctagcattaaggctgagttctaaggccagatgaaagatggaaaaaacaaatactgaaactcgtaatagtgatatattttttaacaacaaagtatgagttggattaagatcatccgtcatggtttttgaacttaaagaaaattcatgctacggatatgccctaggtaaactctccccatccccatccatcttccatccccatctcatgtcaacctcttcatgtttttctaagatctggccacattgatctttttataaattttaaagcatacaacattttctcctgtttcaggatcatacctgtgtttgttttgttttgttttagatcttagtctgtcaggcatttgaaccagggtgacttcatcttgaatagggggcggggtaaaaatgaggctgagacctgctgaaatgcatttccaggaggctaggctttgttagtcacaagttaagacaggaggtcagcaggactggtttcaaaagatataggtcgcaaagaccacactgatgaaacaagatgagccgggcacgttggttcattcctgtaatcccagaactttgagaggctgagacgggcggatcatttgaggtcaggagttcgagaccagcctggtcaacatggtgaaaccccgtctctactaaaaatacaaaaattagctgggcggtagtggtgcgggcttgtagtctcagttatttgggaggctgaggcgggagaattacttgagcctgggaggcggagtttgcgcagtgagctgagatcatgcccctgcactccagtctggatgaaagagtaagaccctgtataaaaaaaaaaaaaacctggatgtggtaaagaagctaggcaaaacccacccaaaaccaacatggcaatgaaagcaacctctggcagtcttcactgttcattaaacgctaattataatgcatttgcatgctaaaagccacccccaccagcaccatgatagtttccaaatgccatggcaatgtctggaagttctcctatatggtctaaaaggggaggtatcctcagttctgggaactccccacccatttttaaagggagttgtcagaactgaaggtgtctcctttttagaccacacaggtaacttttaaaatttttaactttttaaatccatcccttgtttagcatatgaccaataaaaaaccataaaaatggacaactaacagccctcgaaactgctgtgcctatgcagtagccattcttttgtttctttacttctttaataatgttgatttcattttactctgtcgactcaccctgagttctttcttgtgcaatattgaagaaccctgtcttgtggtctggattgagacccctttcaggtaaaagtctatgatcatttttgaaagaaagcttccctaaactttagtataatttacgttccctttaatatgttctcttatgtcatgttttcttcaaagcacctaccttaatgtgtaattacatatttttatatattcagttgttaaccaaatttctctcaattggctctaaattccagaaaactatgcacatgactgctgtgttcactatcactccatcattaactcacacaatgctaactacattgtaaggacacaataggtgtctgtttgatgacttaatattctgttgtttatgtaaatgtcatttcattcttggaaatagatattgctttgtttcctctgtagcccccagaattcacagcacagtgttctgcatattacttttaacatgtgaaaattggtgaaattttcaaaatattagcaaatcatatttattgagcccatactaggtgattggtattgggttaatcattatatttgtgaatctgttttattttctgtgaagttaaaatgatgtgctagataatatcaaagtttttaggcactgctattcttggcttttaaaatattctgcttgcctatcaatgtcagttctattaatttagggaggaaaaaggtgtttttttgcagtaccttcctaaaacaaacctgctcaatagttcaaggcgatctcaatttttccacagaagtctgcaacaaattctcaaatctgacagaaaagtacctacataatattgagaatataattttgatactgatgatatatgtatcttttgagtagactttctagagctttgttaaaattaaaattagtagactgatacttgtatatcggaagatttctaaggtagccaaaacaggcttctcatgaaacaggaaaggcattctgattgacaagctcatgttttctctaaaagtacttgtttcataccaattttctgccagatggaatattgcatgatggtactgggctattatttacacatctgttgtcactcaaattttaattttattcttcatattattattcaaaaattaacctaatagaaaacacataatatgatatgttgaggaatgatgatgtattattccctcagagtaaaagtcatacatcatttctaaaatgagagaaagacaaagttaatagaatatattttgacatatttgattcaaaattgagtgtcttcatatatctgcattcatgatggcattctaaaggagagaaaataaagtcttacttgaaagcacaaacaaaagataagagaaactggcacattaacatctcagaaaatttctgttggtagtttaattgaagatcgtgaaaggaatcgtatactgttcctgaaagatacacttttatttaaaaagtcttgtatttttagcactcattggcacatgcaagtttcatttcgtatatgtcaaattttttcacatactaaaaaatgttgtatacacaaatcaacaaagatttaaaatataaaatcaaatgttatatttgtacaatgtgtctataccaatatgtattcatacatatgactcaagatattcattatctcaaacttagaaccaagccctacatcagaaaaactaaattttagtaccatttcaacatgagatatttggctgcttgggttgattttgctgatttggccaactgggattgtattaatctgtttgaaactgccataaaacaattcctgaggctgggtaatgatgtatttggctcatggttctgcaggcagtacaagaagcatagtgatggcatagcatagtgatggtatctgatcctgacgagggcatcaggaagcttacaatcatggcagaaggtgaagtgggagcaggcgtatcacatggtgagagagggagcaacagagagaggagggaggtgccacactcttttaaacatccagatttaatgtgaacgcagaatgagaactcagtcattaccatgagggcgacaccaagccgttcatgagggatccacccctatgacccaaacatctcccaccaggtcccaccttcaacactggggatcatgtctcaatgtgagatttgaaggagacacacacccaaaccatatcatggataaaatgtccttcttctattattatattttagtttctttatatacagcatatgatatgaaaatttatatctgaaaatacatgagttattttatttcttacaacatatgaacaacctcttaatataattaacaaatatttttggctcctacttatgcttattatccataattaatgtttcatttttctttggtggagattagacatggaaggttgtgaacctagtaatagaggagaaatacatgaggattttatgaaaagtcttccccacagaatctcctttataaggcctaagattcctggtattgctgtgttcccatgcttgagggcatggcaaagagagtggcaagggatagaatagctgggaagggggcagaggaagggctcaattatctgaggctgatgttttcaagcatgcctagctctgtttactccttttcaaactaaattatatattgataacaagagaaatgattatacaatgttttcagataatcagtaaaatggccctcttcctctgagatcacagttgccagagcacttacatttctcctacttttcaaacttgtccaaatgttcttcagaggtatagtcttacctgcataatagacaatttctacaaggtcaacctctatttcctaaagatacattcatatgtggagttcaccaggatttggacagttgaagaatctctcatgtaggcagaaagcaagggaagattgatcaatacctgaatgttccttgctatcatatttgataggaaacaaaatcttttcagcttaatctgtttcctaaaatgctgaatttctatttcattgaggtgaaagactatataaatgtaaacacaatcttgcttagagatgagagaaagcccttatgttgggtaagctctagaaagatggaagtagtgtgtagagaggaacatattttgaggatgaaagtatttggcttcagctttccaaactgaagcatagcttttaaatgtctgacattaaaatctacacatatctggtgctgggagcacaggagagaaaggtcacatttgtgttgtccttgttctattacaagagactcctgaagtatgacaaaggagtgagacccaatagaaatctggatagaaatctggctcttttattgttgttctcatttcatgatagaaggtttagttccctcttgcttttgaaagtagagagcaaggtaggttgatgggacttttctcatgcatcacacctacatcactaaacattagaatgcaacttgattttgttgggtcaattcttaagtgaatgatactcagaagacccagagaaacaaactagaggtaagaaaacatatccagttaagagtgcacctgatcttcactctgttaggaaaatcatgcatcttactctattacagagactcttaaaggagattgttattatctctacctcaagaatacctcaagaataacccaggtattcaagttaagtagtttatcgatgtacacacaaccacagagacaagctatgagtcaatcctaagtcttgatgtttctaaaagcaaactccatttgtaatagtacactgccattcaggggtggctagataatttgcaggaaataatacaaactgaaaattgggatatcttattcaaaaagcaaaaatagtgttattaaaatattaaaacataaaggttttttctttcattggctccttcttgactcattgtgatttaatatttttctaagtaaggtaaaataaaaatttatttattagcttgaattagccatttatttttatatcgtacaatgcaattttaaaggcaaatataaaatacttaacttgtatgcaaaattacccaaaatatacaattcatatttctttctttttttccctttttagtcagggccttgctctgtctcccaagcctgagtatagtggtgtgatcataggtcactgcagcctcacctcacctctgactcctgggctccagcaatctttctgcctcagcctccagagtagctgggaccacagacgtgtgccaccacacccagttaattttatttattcatttatttatttatttttgtagagacaggttctcactatgttgcctaggctgctcaaattcctgggctcaggtgatcctcccacctcggccttccaaaatgttgtgattacaggcatgagctactacacccagcccataattagtatttcacagctcaaacacaactatctgctttattgttaacaaaacagcagaaatgctgcacaacactggctgaattgtgcttcttgtaattatgatacgtgcatattctaccaactctctctacttcaaacttactgatgattaaggaatgattgaaaaaagggattatggatttcctcatctttcccctcccatgtcattgttttgaatataagtcataggctatccaaggaagtagcacaagtaagaaagaatattgtagagctgcctggtgattcacatttggtagaatgctatcactttctttctgtgtttggaaaaagttatcatttgagtggaaaatgtaggctttcttgtactttttactggctttgtggcttgctcaagctctaaacattttgagtgcttacaaaactctggttatggggtgtcacaagtgctatagttgaatgggttggcaaggaatgggagacacggatgttacatggatcacctcctttcatgcacatgatccattgcctttgttcagacaaagaccctttccagaaattaagacattggactgaaattcaattaagaaattcaaagcagcaaaaacagagcattaaatcaagcacagtacaactgcaaaggtcacacattcgtgaagccagctctatagcttttttagattctgagctgtggggccatataggacaagtagagcaacactctctgaaattagcacatgacaacagaggacagtgaacaaattacatgtcagtataccttcttgcagagggcatggtagccaatttgatgaaagaaattcatgcccaggaggtctagcaaataggccaagtgggattgactaggtatttgaggaggttgacagtgatgaaataaagttaagtagaccccgaaattcagcaaccatttcttaaataactgtgaatgcagtaaaggaatgttataatattgatggtcagtaagcagagtatgggtataaagaagttatataattatgagaccaccgatgttaactccattataaatgaaatttaaagtagggaagtaagtgaagtgtcatttaaatccggtaaagacagggagttaagtcccccagagtgattatagtccatgtgcttccaagataatgcaggtaacactgaaataactaaagtgaatactcaaaaagcaagttgttattaatatgacacacattattatcaaagcagttgagagtggacaagattgacttctcagtaaagttttctctgcctagtttaagtatataagtaagctatatttggtttaaaaaaccagaattttttccatatttatactaaactatggttataaaaatttacatgaaagagttaacactactaactctataatatttatagatataagaaaggaagacaacaatgttgtaaaacaatttctattcccaggtctgacgagtttcggaatgacatgtccatatgttcaaccgttcctcaaaggctgtaagagtctgtgtgtatgtatgcatgcacatatataatttcaggaatttggcttatataaaagttaatgcaacacagttgtactgattaagtccactcagtatcttctaaaagggtatatagaattcttctctacataaacaaagcagatgatatcatgatatgattacataaaaaagaggcaaatgtgaggaaataaattccattttgccgttaactaaatatgcttaaaactgtgcagtgcaaaatattgaaagtaagagaaaaagtctaaatatttaggaggtactgcaaatttgtgttccctcaaaattcatatgtttaaatcccaacccacaatataatggtatcaggaggtggggcctttggaaggtgattaggtcatgagcgtggagccctcatagatagaattagggcctttacgagagagactccagagaactccactgcccctccaacatgtgaggttacagcaagaagatggccattgaagtggtccctcaccagacaccaaatcttttgtcaccttcatcttggacttctcagtctccaaaactgtgagaaataaatttatgttgtttataagctagccagcctatggtattctgttatagtagcccaaatgaactcagacaagagggtaagaggaattacgaagaaagatttagaggaagtcattgaagaagtgatcaaatgtgagaggaggcatatagcatagaagtggttctgtcattttatttttctgtttttataagttgtgaataatgaaaatgtatcaaatatttcagataaatgacatcaaaattattttgttgcacatgagagcacatttcaggagcagaggcaaaattaagctgaaggtaagttatgtttatttagatatatttaggaaaaaactcagccaatcatttcaaggggaattgaataaataaataattgttgctggttaatattaacttgtggcttttcataatgctatatataaattttcaacatcagtgagtataaaaaagtaagtcagcaagagtaatagtatccttattttatgaaggatgtatagaagagatgatgcacaaatcaacaggtcatatggtcacaggatcctagggttgtcacttcaccagccagatacctcggtggccagtgttgcctttgcctaagttttgctcaggcccactgggctcgttaagcccagttgctctgacaggttgcacttggcttgcgctacctgcccagatcccatgcctgctaagggcgagccaggcgtggagcgactaggggtgcaagagcaagtgagtgtggggtctggtcactgcttacagtcaagtacactggctgtggcagggtgggcggctccaggcaccagcatgggtgccacctccctttgatgctgtggctggaccagaaatacagcaagcagtttccattgcaagcaccagggaacgtggtggtgtccagaaacttggagatgccaggaactgcagagccccaaagagagtgtcacagccctggcttggggagctgctaggtctgggctccccaaagggtcacagctcttctctcttttctttctctcgtcgcctacaatgtggcaagtaaggggcctgtttcagccctgtttgtgttacagcactttcagccctgcaatttggcgagtcttgagttcttttcccacatctaggaagaatgaagtaagcagacaagtgagatgatccaggtgaaaaggtgcttcattgaactgcaaaacagctcagagaagacctgcagtgggtcttctcctccctgcacgcaggtcatcctagtgagtagctagctcccagcagagaggagacccacagtgggcagttcctctgtgcaggcaggttgtcccatcatctgcttgagtctggctgagtctggcatttttatggacctcagaagggaggaagtgcatgctgattggtctatgggcagccatgggcacgcccagaaaaagcaccgtaagttctcactctggcccacagaactggcagcctggcccgcaggcctcaggccctttctggcctgaaggtggggtttcaccagggacctgtccctttctgcccaggagcctgtctccctcctgccaccattaacctgccatccaatattcccatggcacctaggctgtttgtgccaaggggtgcctgcagacccacaccaagcggctctcagcacccccttagcctccctctcatgctcatcagtacctaacatccagagggggctgaagtggcagagagctggcatgtcagaccttctctgagtgtgcacacacctggtgggttgcaacagcacccaggcttggcctcaatttgctctgaaatcggagcaagcaccaagagcaggaagaggccaggcagcaggattaggcacttctgatactgtgggggaagggaggcttcctaggcccccaagagtgcagaggtgaagggattcctgagtctgcagcagcagctgggcagctgcagctgtgcccaggaggcaagggctcctgcctgctcccaggccccaatagcatagggaggcctgggtccagagtcacgactgggtggctgcacctgtgccagggagcctgaagcttccaccctcccaacttggttgggggtggggcttccacctgttcctggctcctgccagcgccgtggagcacgtagccctggctgcacctccgccactgcagatggcatcatggcagcagccacttaagaagggctgctgctgccatgaatataattaaaatcatctcattttatataatagtgtaaaaacttatatgtgtgaactaatattgatgtgtatttttaaaatgtattcacagggaaagaaaaaatactggtcgaatgtcatgacttaccacttgcatttcatttgtttctgctcaggcagtttttggcaaatataccaataaacttgtcttctaaactatgtataacttttagttctatcgagtttcacagtcacattatgtaaagcatttcaaaaaatatctgccaggggcctgctctgtacaagtcacatggtagggtgaagataaagaaaagataaaaattctctatcacaaagctcctaacaattcatagagaaaagacattagcttttctaaagcaatagaaccatcaaaaatatctccaagtttactaattaaatgttatggtactcttttagtgttctactgctgtgcaacacactaccaaatcttagaggattataacactaacttttaacttagttttgtgagtcagaagtttgaaatgagtttcactgggctaaagtcaaggtttcgttagggcagcattccttctggaagctctaagaaataatccatttccttgccctttccagctttcaaaggtcactaacatgcatgatcactttttcatcttcaaaaccagcaacagtgggtccagttctcacatcacattactctcacctcctcttctgtctccttcttccactttacaggtccctttgtttacacccagcctacatagatactctaaaataatctccaaattttaaggacagctgggtaagcaatttttttcttttctttttctttttttttttctttttgagacagtctcgttctgtcgccaggttagggtgcagttgcgcgatcttggctcatcataatctccgcctcccgtgttcaagcgattctcctgcctcagcctcctgagtagctgggattacaggcgtccgccaccacgcccagctaatttttgtatttttagtaaagatggggtttcactgtgttagccaggatggtctcgctctcctgacctcgtgatctgcccccctcggcctcccaaagtactgggattacaggcgtgagccactgtgccaggctggtaagcaattttaattctatctgcaatcctatttctatttgccatgtaatgtaacatatttactgtttctggggattaggtttgtacatctttgagcatcaatattctgactaatataggtacatctggtaaaatttgaatacccgaggggataatgactgaagtttgaaatagtagggattaactatgtaaaagatacgacaactaaactatgatcttctacgtgtgtaaaattcaaaacagcaactatgtcaattttgaggttatcagacagcaaaatatctttagttcaaattattgattcctataaagtcaggactagcagttgctccataaatcataagtataaatattaaacattattacgtatacatgttttttactcaggtcaccaaacgtaaattaattaaatagttattgggaatcataatttctgatacaagttttaagttcagcacaaatttggcagatattttgtaatttgttctaacacaggctgtaaaatggcacaagattttattatgatgccacaatataactaaaagcatattcagaaaaacacatgatttagtatggtttcaattattttcaagaaaatcctactgttttagtttatatcataatattttaattcctgagattgacaatgttcaatgaaactgtagacttccaattaatccaagtatacaattatttttctaaaatacgttatttcctgagccaaggaggaatgctgaattttataaagtgtctctacctttagatgcattggaatcagtagccattttttccctcattttaatctagatgtttggtgtctcagggagaaaaaattagctcttatttcatgaacacctcaacagacctcaaatctagatgaatgacactattacttgggtggataatccatttttctatagtgacaatctgccctaatgttttagtagtgctgttttcaaaatgtgatgttagatgcccaaatatatgctttagtccctgaagtgacagttaaagaaaggtatcatgaataagtatttaatgtggaacaaatattacataaaaatgcagttattctttttttgtaaaattaaatggcataaattaataaggaggtaatattcttaaaatagttatgatatatgatgatgatgtttttcatctcttttttcgtacctgcatctagagatcctttgatgggaatgtctttaatataacagatcttgttaataaaaggagggggcagcagcattgagttttcatgtatcttgtcaaacaactaatacatttagggcagtggtcctcaaactttttggcaccagggactgggttttgtggaagacaattttccatggactgggatgtgggtgaagggatggtttcaggatgactcaagtgcattacatttcttgtgcacttcatttttattattattacatcataatacttaatgaaataattatacaactcaccataatgtagaatcagtgggatccctgagcttgtcttcctgcaactagacagtcccatctgagggtggtgggagacagtaacagatcatcaggcattagagtttcataaggaacgtgcaacccagatcccttgcagcacagtccactttagggttcatgctcctgtgagaatctaatgctgcagctgatttaacaggaggtggaactccagcattaatgcaagcgatggggagtggcttaaatacagaggaagcttccctcgcccatgctcctctcttctcttgatgagtggcctggttcctagcaggtcacagactgtcactggtctgtggccctgtggcttgatgacccctgagttagggaaaccctggggcattatataatattacatattctcagtaagcagctgataacctaagaggctccttcctatataaatatgctgtaaaatagatataatgacagtagtaaatacaataggattttaattaaattaatataacagattattgatgaatacatgaaaaaatagtactacatacctcaaagcccttagagaaattgtcccagctcttgggcactgaaggaaatttctgaaaggtcaaaaacagatgctttgtgaacaagtttcttcaaaagcctatacaatatgtaggttctttggtattgctaatatttaccacaattatttattattttactcaattttatagaaaaggggctgcaaaatacaaaattttattatttattattttatttttctcaaattcagtcttctatcttcttttattttcttttagcttcaaacatttcttataacatttctttcagcttagtttgtctgacaactagttatttcagcttctggccagctaaatctatttgtttttacttttgagtgtaatttctccaacatacagattctaggcttcatgtttttttagcaattaaaaaatattattccattgtcttctggtctccattgtttctgttaagaagccaactatcttccatggttttcaaccatttgactctgatttgcatggctttatttgtattatctagcttgaggtttgctgagcttcttggatctgtgaattgatcacagatcctttgtgagttgttacctttaagccttttgcattctctctccagatatttcttttgtcctattatctctctttcatttttctctgtttccattttggataatttccagtgaactcttttcatagtcattgacactttatttagttgtgtccagggtgcaagaaaacccttcaaatgagttcagcattttgatttaattattttagcaaataagttcaatttattttagctctccagcccttctccttgaattctgtgaaccacagctttgcccataggaaaaacactgtaagaatcacagtataactgcccaccttcatcttcagcagccaatgtcctgcaatctgtgaagtcctgggataatttaaagggatatgaatataaacgagctctttggctgtttgatgtactaactctgagatcttataagggattgtgcgatagagttgttgggttgcagttaggaccccacaaaattctaatccctgacactagctgatatgcaaccattaaagttatttaaaacgtaatcagttcctccttactctcatccatatttgatcttccaagacctgcatgtcatccagggaggaaagaagctataaaatatgccactggagggaaggctcatcattttctgaattttagttcgtttaggcttgtttagacttctcaactgcccaatatgtttttttttttatgattttgcaatttatctagtagatctcatcattaggatgggagtgacaatctcttctgacttgctacaattctaacttgaagatgccttgaattaatttagtccaatagttaattttagtaacctaaaatgtgtgttaagtgtaagagttttcctctaattcattaaatttcttttttttttttttttccagatggagatggagtccctctctgtcacccaggcagaagtgcagtggcgcagtcttggctcagtgcaacctctgcctcctgggttcaacggattctcctgcctcaccctccttagtagctgggattacagcccgtctaatttttgtattttttagtagagaggggggtttcaccatgttgaccaggctggtcttgaacccctgacctcaagtgatccacctgccttggccttccaaagtgctgggattacaggctagagccactgtgcctggcctaaatttcatactatacgcatttaccctctatttaatataatacaccaaataaaggtatagaatatcaagaaacaatatggaataatttcttatatacaaaaactttaaaattagttaagaaaacaagtgaaataaacataagaaaaaagttaataactttggacagtgataaattgtgtggcacagataaattttaataagaattaagcttatttagacatctagttacatttaagacatcatgggtgaaagaagattacagttaaaacttgactctctcttaagtaaaacaaagaaagatgtaatagcataagaaaaactaaatgtccttctggtgtcaagtccctcattttttttgtatgtgtttagagtgtattggggacaataatttcaatagcgtaaattatatgtaggccataaacagcattgtaagtaatcagtataaaacaaaagttctgggagaaccaggtactaaagataagacaaaccaaagattattagaataaaataatagatcaaaagaacaaaagaggatatatttccctaggaaagaaaaacaacaaaatttcaattaaattgttggattttaaaagcatacaatttaaaaaaagagtctgacattatcaaaggccagagtaaaacagtgagttaaaattcttgattaaaatattaaacttctaaaatatgaaatatgtaatcttgatgtgaaggccagcattgagtgtaggcattccatccatgtttgctacttcgatatgtgttgcagaattcaaatgtgaaaacagctatcatacatagcggaacagaaaaagaaaaagtagaactgaccattaaaactgatcatgttatagagaaggttggaatatctttattaaggagataaaatgcatatacataaattttctatgttgaaagattataaacttaactgagaataaatataaatcaaacacttggaaatatgctgaaataattactaaattaacagagtttatgtcaatgttatacagactcaagcagtctaaaggtcacagattgcttacaaaatattttttaaaaaggtaattcatgagacaattataaaataaatgggaattttgtaaaaagtctgcaaagaacttttcaaattttacattaatagaagattgaaacagattgaaatgtagtgagtgaaaatagattcattcaagatgaacatcatttccattatttctagtacccatatcaaattagagatttaagatgattacacaaactcagtaattacctttaattatgtgggcactagatgctttgatttttattttcttaacatcacaggttatttctaggtattttgttaatataacaaattgcaaataaatttttagtcgaatagaaaaatagcttctgaaataaagggtttatgttacaaaagtaaccaactttacccattatagtttaagaaaaacagaacactgtgtattttaattttgcaaatagttacatactttgaaatgcaactttaattgcagaaacttggatgtggagagtatagtaaaaccattaataacttatctttataaccatttacttaaaaatacatttataacaataaaaatacgttattattgtaaattccagtggctatatctgtacttataaaatatatacaggaagctatttcaaatatgtaaataatgacacttctgaaattgcatttaaaataacttcaacaatacaataaaccacagagttaaaccacggaaaaaacaatatacactttcactatgttaaaaatatatattacaaaatgtgatatgggcaatggattagaattaaaagttaattaaaatcaagtaattttaaaatattataaaattaaatgttagtctcatagtatgtttttggttaaaatacagtttaaaaatactctcatgtttttctaatttattcacaggcaaacaagaaatttactttaaaacaatatccacaatttaagattaatatagatctcatatgtatgtattttgttgttaaataattttggacttaactttccaaaatttagttttatcttatatgaatctattttatattttctgtttgccatttttgactgaaaattttgccagagatgctaaactactatcattgaccgtttttttaatggtgtcctgtgattttaaaatgcatactttaacaaattaagcatgaatatacatgcaaaataagaataaatttgcatatttgtattatattttcttattgattctcatgactaattatcttatatatttatactacaaatatggagaagaaaagtaaatttttatgagttttactctcagcaaagcaggaaatctggcattttatgattttagatcatcatattaactagaatccagagtatcaaactgagggcataaaaatcttttttggctgcaaatttttctagactcagtggtaaagctagattgatgactgtttataatagcaataatccctgcaaaatcagtcattaacacagttaacaactaatttgttggagtgttaactgcccttggctttgcctcaagctgttagcaagctggtcattaactgctggttacaaccgatttcttggggccctatttaacagaaatttgatttcaattccacacccacagagactaattttgattcggtaaacgagtctcttttcttaacgttagccttgatacaattttgttcttgtatgatgtatcaaaaggcatttcccaaaagccaatgtgcatttaaaaaatatatgattactccagagataactagatcaatgcctatgtttctcagcctatgtggcaggactgtcagaaaatataggacaagaaaaacattgaagaatataaaatcttcagttaaacttgttcatatattgcatatttacaagggcattctattgaatgaaaccagtatatattcctcaaatggtattatattatttagtcatagtcatttatggtaacaaaaggaaagactaacaagtatgaaataagttaaagactaacaagcataaataagtgtgaaaactgccttctttcactaagcctaatcacaaaaatccccaacatattgccatgtgcgattttcaaataaaatccagcattcttccactgaaaagtgctgtttagtataggattttaatcatttactcattcattcaacaaatattgatagagcatgagctgtgtgctgggcatagctgtttgtatttgagtaaaacagagattacaaatttggggaaacttagcttatacctcgttaaaaaacaaacaatacacataaaagagataaataatgtattaaaaaatgataagttattttaaaaagaataaagagaaaggggagtcaggaagtaaaagtaggtgttatggtcaggttgaagtttgaaattatacataggaaggtcaggataggcttcagtaagaaatagagtttcaagaaagacttgaaagaagtaagagagttagtcaaatagacacatttgaaacagaaggaacagctagaggaaagttctttttttttttccattaggtaaaatatacaaaaaaagaggcttaccatttgcaccattttaaaatgtacaattcagtgacttatagtacatttgcaatcttgtatagccaccatcacgctctatttccaagtttttaatcaatcaaaacagaatctctgtaactactacaaaataattcccaattaccccttccgcaagcctttgataacctcaattctactttctgtcttcatgaatttgcccagacgagatacttcatagaagtaaaattatacctttgtcattttatgactgactcatttcacttagaatattttcaaagttcatctatgttgaggcacatatcagaacttcatttttttaaggctgaatattattccatcgtttatttactcatctgttgatcgacagttggtttctttccaccttttggttactatgaatgatgttattgtgaacatgggtgtataaatatcttttatgtccttgattcaatccttttgggtatacacctagaagtggaattgctggtaatgcggtattcctgaactgttggaagaaccacaaactgttttccacagtgcctctccaacagacagaatattcagggttttgtttggtttggttggttttgttttataacagccaactgaatggaagtgaagtgctatctcattgtggttttaatttgcatttctctaatgaccaatgatgtttaacatcttttcatgtgcttattggccatttatatatcttatttggagaaatatctatataagcgcttagtgcattttgttgttgctgatggtattgtgctgaaagaggtttatatattctgcatattaattccatatcagatatattatttgcaaatattttctttccttctatagattttattttcaccttcttcatagtgtgttttgatgcactaacatttttaattttaaaaaagtttgacctatttttttcttttgttgcccgttctttgggtgtcatattccaaaaaagcattgtcaaatctaacatcatgagtatttttccctacgttttcatttgatttttatagcttcagctcttatttttagtttttcatctattttgaattaatttgtgtacaaggtgtaaggtaagagatcaacttcattattttgcctgtggatatccagtttccccaacactcattagttgaaaagaccatccattcaccagtgaatgaccctggcactcttgtcaaatatcaagtgactaccgatgtcagtgtttccagcctttctattctacaccattggtctatatgccagtaccagacagttttgattactataggtttgcattaagttttgaaataaggaagtatgagtcctctaacttttctctttttcaagattgtttctgctatttgggatcttttggagttccataggaatttggggttgaatttttctatgtcagaaaagaattattcaccgagatttcataggcattgaattgcatttatagatcactttgggtagtattgacattttaataattttaatccttttaaccgagaacatgtgtttttcttttccatttatttgtgtcttctttaatgtttgtcagcaatatttataagtcttacctccttgggtaaatttatttctaagcattttattattttcaaagctattgcaaatgcgtgttttaaacatttttcttttttactatcaactgcaagactatgcaaatgcaactggtttgtatgttccataactttgctaaatttaagttttttagctctagtaattttttgttttcttttcttttcatgtgtatgtgtgttctttaagagtatctaaagctaagatcatgttatttgcatagagagaacattttatttttatttttctaaaatgaatgctttatgtatttttctaatctaactgcatagactaaaatttgcagcactgtgttaaatataagtgataatagtgggtattttttttgttcctgatcttagattaaacactattagtccttcaccatttatatgatgttaatagtgaatttttaatataagccattaatcatagtgcaaaaattcctttctaatcataattgagttttttaaaaagtaatgaaaaagttttagatatttttgaaagtttttttctgcctcagttgagataatcatgtgctcctttcccccttcattcaattaatgtgttgtattacattgattggttcttgtatgttaaactgctgtattagtttagtctctcattgctataaatagatacctgagactgggtaatgtatgaagaaaagaggcttaattggctcataattccataggctgtacaggaagcatgatgctggcatctgctaggcttctgggaaggctttaggaaagttacagacatggcagaagatgaagcagtgagtgcttcatgtgaccagaatgggaggaagaccgagtcgagagggaggagatgccacacacttgaaacaaccaggtctcataagaacgccatcaaaggaaaagcactaaagtgggaaatttgcccccatgatccagtcacttctcaccatgccctacttccaacactgaggattaaaatttgatatgagattcaggtggggacacaaatccaaaccgtattaactacccttatattcctagggtaaaactatttcgtggtgtataatgatactaatatggtgctagatttgatttgctattattttcctgagtttattttacatctatagtcacaaatgaccatttcctatagttttcttttcttgtagtacctttgtctggtttttatatcaaggtaatgctggcttcattacatgagttagtcagtgttcccttcttttcaattatttggaagagtttgacaggagttcacttcaattcttcatcaaatatttgaaaaaatttaccagtgaagtcatgtggtcctgggcttgtctttactgggaagaattcagttactgattgaatctctttatttgctataagtatgtacagattttctgtttcttccggagtcagttctgattacagaaatttgttcatttcatctaggttttccaattttgacatataattgttagtagtattctgttatatttctttttatttctttaaaattattagtattatcccattttctattctaagttggtaatatgtatctttttttatcttaatgtagataaagtttgataacataattgatttttccaaataaccaaattttgttttgttaattctattgtttttctattctgtattgtatttttctgtgctctaaactttatttcttttcttttgctagatttggacttagttttctcttttcctaatttgttaaggtgtattataaagttgttcattttagatctttctgattttagtaggtgtttaaagctacattttttcctcttggccccgatttatctgaatctcataactttttgtaaagtgtgcttttatttgtattttttcaaggtatttctaatatttctttttaaaaaaagttgaaacttattcattgttccattttattccattttattccattatagtcaaaatagatattttatatgtgtattatcttttaaaatatcagactttttgtggactaatatatgatctatcttacattccaggtgcacttgaggaaaatatgtattctgctgttgagtagttttccaacaaataattagtcggtctaatattttaacactattcttcaagttctctattattgactttttgtatgcttgttctattcattattaaaaatttggtttagaattctccaattattattgtttaactctttttaacttggttaatttttgtcttttacatttgggggtctgttgttaatatgtttctaattgttatatgttcttggtgaatgaaattttattatcaatatgtaaggttcttatttgctcattgttaccttatttggacttgaagtgtattttggtggctatgttatataaaatacattttttttcttttttactttcaaactctttgtgtcttagtatctaaagtgagtctcttgtattatagatagatctttttttaagtcttatctactagtatcttccttttaaaggagagtttaatccatttacatttaaagtaattaatgagaaggaaaaatttacttctgtcatttaactatttgcttctctgtctgacatttttgtacttttcatttcctccattactgattatttttgtatttcattaattttgtctagttattattttaacttctttccttttctgtattgctttagttattttcttagtaattaacttgtgcattaccattgataacttgaccttatggcaacatagtttgaataatactatcatagttttattaatatacaagcactgtgctcctatacatctctgtcactttgccttcatatttttattgtcacggattacatctttatacattgtctgtcttttaagataaatatataattattgttttatgcatttgccttttaaataatataagaaaaaaggagctacatatcaaaaatacaataatactggtaattatatttaatctatgcagttatctctaccagtgttctttgttttttctcatggcttcaagttactgtctagtgtcctgttacctcaagctgaaagacacccatttggcattccttgtaatacacattgactagtaataatttccctctgtttgtgtttgtccagaaatatcataatttcatcttcatatttgaagaatagttttttcagatactaaaaacttggttgagatgttttgtttctgttttgattttcttccaagaatttaaatatgccatcccactgccttctggttaaatatattatctcaatccatagtctgatgagaaatcagttattaaccttattgagtattccttgtacatgatgaattacttctctcttgctgctttcaaaattctctgtctttgggttttgacagtcagactatattttttggtctgcatttttgggtttatcctgcttggagggctttgagattattgggcatgtgtattcatgtttttcatcagatttgagtagttttgggctattattcttcagctattttatgcctcttttaattcattttcttcttctatggagtctccctctctcgcccaggctggagtgcagtggcacgatcttggatcactgcaacctctgcctcccaggttcaagcaattctcctgcctcagctttacaagtaactgggattacaggcatgtgctaccactcctggctaatttttttgtgtatttttagtagagatgttgcttccatgttggccaggcttatcttgaactcctgacctcaagtgaactacatgcctcggcctcccaaagtgctgggattacaggcttgagccacgatgcctggcccttatttactttagctctttactatggtttctttcatcccattgagtgtatttgagacagttgatattttaattttcattttatcttaaattcagagggtacatgtgtaggcttgttacatgggtatgtttagtgatgctggcatttgggcttctagtaaacccatcaccaaagactgaacatactacacaacaggtgggttctcaggccttgtcacccactctccttaccctttcagagtcctcagaggctattgtttccatttttatgtccctgtgtactcattgtttagctcccacttataagtgagaacagagtatttgcttttctaagtaaattcacttaggataatgactgtatccatgtttctgcaaaggaaatgatttcattctttttttatggctgtgtagtattccatggcatatatgtaccacattttttaaattcaatccaccattgatggacatttatgttgattccatgactttcctattgtgaatagtgctgtgatatacaagtgcaggtgtcttctttttgtattgtttttttaaataaaatactttcttttcctttgggtatatacccagtagtgagattgctgagtgagatgtttagttctttgagaaatctccatactgtttttaataggggtttaactaatttacattcccatcagcagtgcacaagcattttcctttcttctcatctttgccaacatctatttttttattattttttaataatactcactctggctgacatgatatctcattgtggttttgatttgcatttctctgatgattagtgatgttgagcatttttttcatgttttctggccacatatgtgttttcttctaagtgtctgttcatgtcctttgcccacttttaatggttttattcttatttatttaagctccatatggatttcttatattattcctttgttggatacatcatttgcaaatattttctcccattatgtagattgtctgtcttctctgttgatagtttcttatcctgtacagaagttctttggtttaattaggtcccatttgtcaattttcagttttgttcccattgcttttgaagacttagtcataaattctttgcctcggccaaggtccagaaaagtttgtcttagattttcttcgagggtttttacagtttgaggtcttacgtttaagtctttaatccatcttgagttaatttttatatattgtgagaggtaggagtccagtttcatccttttataaatggctaaccagttttctcagcatcttttgctgaatagggtattctttcctcatgttcttgtttgttgaaagcattctccctaacatgtggaacaagacaaaagtgtcctttctcaccactcctattcaacatagttctggaagtcctagccagagccatcacacaagagaaagaaataagacatccaaatatgaaaaaaataagtcaaaatatctcctggtggattacattattcattacttagaaaacactgaagatttctccccaaagactctagacctgattaaaaacttcagtaaagtttcaagatgcaaaatcaaggtaaaaaaatcagtagtatttgcacacaccagtaatgttcaggtgataatcaaatcaagaactcaatcccacttatgatagtcatcaaaaaaataaaaaaaaaatacctaagaatatattttaccaaggatgtgaaaaaatctctgcaaagagaactacaagtcattgatgaaagaaatcatagatgacaaaaacaaatagaaaaacattccatcctcatggattagaaagattaatatcacaaaaatgaccattctacccagagcaatctacagattcaatgcagttcctatcaaattaccaacatcgtttttcatagaattagaaaaaaaattctaaaattcatgtggaaccaaaaaagagccagagacattctcagtattattatgcagtaactctagaaatttgattctctaactcctctgggatttctgattttttgtttggtgacatgtgaagcagttttttacttttccaaattatttttatttttgtaagatgtgtattccttgctgtgtgcagtcactgaagtttctgttctgttgtctctgcagtctaatggtgactatgttttttttctttcttttttttttttttttttttttttttttgagacagagtctcactctgttgcccaggctggagtgcagtgacgtgatcttggctcaccacaacctccacctctcgagttcaagtgattctcctgcctcagcctcctgagtagctgggactacaggtgtgtgccaccatgcccagctaatttttgtatttttagtagagatggggtttcactatgttggccaggctggtctcgaactcctgacctcaagatccaccttccttggcctcccaaagcactgggattacagctgtgagccaccgtgcccggccggtgactaagattttttaaaatgtgtttccaagaaacaaaaaaaaaaaacaaaactacaaaacaacaaaggtacactggtcctttaaatcttcttgatcaatgtatctgggaaagctatggtgtcctagaggactaaaaccaaggcaaaaatctatgccagttcctcagggcactgccatatccactaaagtgcacaatcccaaagtttcggagaacatgaatccagttgcctgctctggcacaggccagctgctcctgaagtgcaggccactccttcttcctgagcttttgttatatactgaggaatgggaaatggtagcttggttatgcatgccacgtttttgcctacgtgtaggaacctctcccttcatccaatactctgtttgttgttgtaagtgtttaagcaggtatcactgttctgaattacttaattgtaaatctctctttccagctcaattgttgctttggtagaggggtattagacaataatgtcaaagaggaaggaaatggaaagaaggaagacaaatcatgcagcattttatagtccattggaaagaaaaatatatctctaatgattgaaatgggaagtcattgaaggtttttaggaaaagagtaacatgatctgaatgaggttgcgaaaggataattcttgctgctatggcttagcagtttattggatatgtttggtaaaaaaaataaagtgacggatagtgattgcctagtgaatataggaaagagtgttgtcaggcacacgcaactgctatcatctgtgaaggctgtaggtggagcagattttggcaataagatcaagagttcatttttaatagaagatactgtagggggttgaaatatttatgaaacattcaaatagagatgtgaaagtgttgaatagagcatggagtttgagataggtatttggtaatcaacatataaatagtatttaaactattgggctatgccaaccaatgggttctgtgtctgcaaatgtcttcatttcagcttaatttttgaaggacatagaattctaggctagcaatattgtagtctggcttctatttgtgtgtgtgtgtgtgtgtgtgtgtacatgtgtgtgttgagtaatcaattttcatcctgcattttgcactttgaaaggtaaccttgaattttttctgcagttgcttttaagatttgctttttgtcttgatttatcagaaggtatactgtgatgtttctacacgtggattactttcttattttttctgcttgaggtatgctaatctagcatctgtgtgttgtcttgaatcagtgttatgtattctcaaccacaatctcttcaaattcagtttctggtccattctctctcttttatagatctttacttacatatatgttaaaccatatcactgtattctatatatcataccatgtcatttatttatttatttatttatttatttatttatttatttatttagagatggagctgcactcttgttgcacaggctggagggcaatggtgtgatcttggctcactgcaacctccacctctcaggttcaagcgctcagcctcctgagtagctgggattacaagtgccccccaccaggcccggctaatttttgtattttagtagagatggagagacggagttttaccatgttggccagtctggtctccaacacgtgacctcaggtgatccacccacctcagcctcccaaagtgctgggattgcaggcttgagccattgcgcccggcccttttttgatttttaaactttttgtccttttgtaatttagtctaaatatttacttatgggtagtattctatttaacgaaaaatcccttcaccttttctaatgttatattaaatccatcctttctgttcttcattttagtcagtatattattaagttttgcttaagagtttctagatttctaacaaaattatctattattttattgtctagcatacagaaattatatttatttctacacataatttctgtaggttctttttgttacactgatttttctacatgttgtctacctgcatttatttgtacctagctatgtttgttcgtgtgtggaagttatatttagaaaattgttttagaaatattttgaaaattataataatatcaccctctggggattttttttttctttcttccaaggagatagagggcacaatcactccagcatcatcctaacgcaatgtctaagattagaatgatttgaaggtgcactgcagtctctgattattctgaattaacctttctcatagaattcagagcttcagtatctccagccactgtgatagggttcatcaggctatccttccttggcaagacatggaatcaaatccttctccccaccttcctagaaggctatcaatgctccactctacctcctaactttcagctgccacctccataattaaatagcttcaggagtctctattgccaggctcactccctggttttgagcctttcctggctccttgtctggtaattatttgttatcttcttaacttgcctgtgccttcacttattcagggagattactattgctgttgctgttcagcagcaatcctgagtgaggtttgttccacgttactcactcaccattatttttctccttccttggagcagggttattctgttacgagatgctgtaacgtcctgagttcgttggcttccagccaggaggtgacgtttttaagagagcaccagctgcgttagtggaagggggatataagcttgccccaagatggccaggataagcattcgggtttctcagacgatgggcgaggtcagaaaattcccaagagtttatgtcttctgtgttcaggtactgggcagtagagaaatagtatcaggtgggggcggggttagggggatctgagctcagactatccttgggtggggcttgccacggtcactgtgcgggatggaggggtggttcttgagccaatggggttcagagggaaatgtggctgcctctgtcgccagggaagtgggggaaagccggtagcagtaggcctcacccagctccctcacagttggtgtggccggtctggctcctgccatgccctgccaacagcacgagtttatctccaggcagaccatgacccaaattactcactcactattattaaagagagacctggctttatgaatcttcaatcaaatctctggttcaataattatttaatcaaaaaaatctaagtttttgaaatagtgacacatatcaatatattgacttaaacatccaggtctgtgtttagtaataatgctctaattctctgggtggaaagctctacatacattcatgtaccacataatgacattgcagtcagccaagaacagtggttgcatgtttatgatgccatttttgactgtactttttctatgtttagatatatttagatacacaaatacatacattgacttacactcgccttggtattcataacagtaacatactgtacaggtttgtagcctagaagcagtaagctataccatattacctaggtgtatagtaggctatttcctctaggtttgtgaaagtacattccatgatgtttgcacagtgatgaaattgtctaatgacacatttctcaaaatgtgttcccattgttaagtgatgcatgggtgtgtgtatatatgtatatataaaacatgtgtgtgtatatataactacatatgtatatataaaacatatgcatgtgtatgtatatacctgcatatgtatatatgtatatctcctattattggtacttcttggtagtttgatgtggagtttaatttctattcactgacttcttttctcagtttttcagaactatcattttactttatgttccctgatactgcagagtacatgaaaactatgaaaattatcacaacttcatgtagtggctcaaagggatatcattagttaacaagataatgaaatgaaaattttggaaagaggtattaaaaattacagctggtaaaattgaagcaaatgttggagagattagatttttaactagaacaaggaagaaagcaatgtactgcttattcttcaagtcatgatcatcattattattttgctagcaacatcagcatagaatgttatgctttgccttttatgtatgtcaaatatattaagaacatcctatagatttaatactaatgtttgtgtctatatttgagtaattttctagttactatttttggtttgcacatataccctactcttcagattaactcaacacctcaattgcagaagtcacacagtttaaactgtgacatttgtgatcagagaaatctgcattccctaattattgaaacattcttccagcatgtaaaatatgaaagggtcataatatcctctctgtccttctagttaaagatacattctgtgatcataatttaaaggtagcatacaaatgcatcaggcttatttcaacatttgtctctatactttttcaaatgtttatataataaaattactaattttttgatagcagagttgtataacttcttatccttttgcctgaggcaaagtgctagtatttgatttatcttctgtacttgtttttcttttaacaatatgaactttttcccagacaagtgcaatgctgtgtgtgaccccacagggaaatatttttctttttaaggaatgtgtacaaagtacttaataagtcatgtcatcccatgatttactgtatattatatttttggtgactacagttaactttctcggtctctagatgccaacattttaataaaaacaagacattttcaacgaaatgtcagaaacaaagtgatcaaagtgctgtgggagcagtttggcaacagtttgagctttgaatttcctattcactttccaaaacattcacttaaaaagcatttattgaagctgaactgcctttatcagcctgatcagagcaccataaagagcatgcatgattcaactgccttcccaagctttaaaaaatataactttgatatatgtctcacgagtgcagcacaatagttttcatgctcacgtttgttaagatttagtgcagccattaaagaacagaagggctctttggtggcaatcctcagacataccaaatatcccaaagcaaaaccttctacaaatcagagattaaggtactgacaaaaatttccacttgattgcagttttcccctttaaaccttatatcaggagtgactatcttttcgatcaaatctcttagggaggtgaatagataagttttttccctcttggaggaaaatatcaactgagagataaaaagtgacattttatgtgccttgtccaaaagtcagtcgatttatttaaaaaacggtgtgtgagactgacctatacatgaagcttgtggcatgtgtcttgtcaagtattgatcacttaagtctttactgtttgcctactgcaatgtagctaataatctctttttatttagtttgtggctttgaattcttatcatggctttgctgatttctctgggacctattagatcttgcttttgctgtgcaaatggctatggaaattaagcttgctgaagcacttttcctgggcaaacactctttgttttctatcagttcatgtgtcaagtggtttgcatgcagatagggtacatttggaagcagcgggcgccatcaatcttcatgactttgctatatacatcgtttcacctctccttggttcaatgggagattgtaaaggatggctgagcaatcaggctattccctttgactgacatcaaggtatttcatctgattcactttagcactttcggttcaatgctggaagcttagaaaatagggcactaggtgatgtggtcaaatgtccacatattttaacatagttactatctctcctaaatttcaaaattgtatttttgaacttcatttacaaaacagaagcaaagctgaattttgttggtttatgtgtgtcctctactcatattattgtcctaaattcttgaagggttagtacaatggctgccttactgcctgcatgacttcattgagttatttctcatggaactgaagatatatatcatttacttattattaataacagttaaagaaagtaactcacattgatggggccatatgcttcacttgtttgcattctaagatgatctacagtaaatgaattaaacttcattccttttcaaggcagtagttgatatagattgaggaagttataatatgtatattacagtttaaaagtctcattgcaccaagtattctctgtatgtgtgttcatgtatgtcttggtgtatatctgtatatatagagatacaggtataaaaagaaaaggagagaagaatgtgctattctatcatttatcaagattaatgaattgaccaatagtgttcagtgttatacaactcagtgtgtctactgcttccagttaacagatcgaagaaataactcaacagaaacctaaaatatattggctacatttaatagccacaaattttcatttgtatttttcttgaaatgatattagtatcaaaatgtcacaatagaactactatagatagaaaagtaataagtaatataattactttttaatttcaaagccatatccaatgatcatttgcattagctaatcaagtttatgtataaatatcagaaccatattatatatacataaatgaggattatgaaggaagaaggtaaaattttagaagctgcacatatgtttgttctaatcaataatgacatagaaagattcaaagtctttccaaattggcagaatcctttagtacttcaaatgttctaatgtttggtttataaataaatatacgttgaagattccatgaaaaacactcaaacattcttaaatctgaattctgaattggtgaacaaagttaaaattgtgaaaaagtctgtatttgtgcatgcctctgtgtgtttgtgtgtttgtagactcactaatgaaaatatataattcttgatgcttactcactgaaaacaaggttaccaattaggatattttagaaaatatattctaaggaatgtatgtcctttatttattattaataactgcattaaaatggtagttttttgtgttaaaaatataagtgttctcagaatttgtgattcctctttaatgtgtgtagtattatttaaccctattgcttcggaataattagactcttaatgaattcaaattagaatatatttattaggttggtgcaaaagtaattgcattttggtcattactttaatggcagaaactgcaattacctttgcaccaatctaaaatttgagtagttaaaatgtgtaaacataattatttgcaatcccatttgccctttgttcttctcttattaataaataattggactttgaaaattacatttatccattatcaatcttttcctttaaagactctttgtcctctccacctcacactcaaagtccaatcacgtggcaacaacaaggaacagttacatcctgatgaaactctggacatagttgcttagtccagagatgagcagtaggtgtaagctgatcaatcagagttattctctggaacatgaccaggatgtacacaatagaataatctcatttttgtcagaataactttttctacattaaaagtacttagaggcagggcatggtggctcatgcctgtaatcccagcactttgggaggctgaagtgggcggatcacctgagctcaggagttggagaccagcctggacaacaaagcaaaatcccgtctctactaagaatacaaaaaattagctgggcatggtggcacgtgcttgtagtcccagctactcgggaggctgaggcaggagaatcgcttgaacccgggaggcggacgttgcaatgagccgagatcacaccactgcactccaccctgggcgacagagcgagactccatctcaaaaaaaaaaaaaaaaataagtgcttacagaaatgcttaacatatagtaatttcgtaaaaagtgcgagtcattattaatttattattattatttgtagatttagagaatgagagagtcaaaatcttggttttaaattacaaaagccagtctttttttccttattttgaggcagtgtctcactttgtcccgcaagctagattgcagtggcaggatcatggctcactgcagccttgacctcttgggctcaattgatcctcccacctcagtccccccacccccgagtaactggaactataggcatgcaccaccactcccagctaattttttaacattttgtagagacagggtctcactatgttacccaggctggtttcaaattcctgggctcaagtgattctcccacctgggcctcccaaagtgctgagattacaggcatgagccattgcatccatcctcaaaggccagtcttatagacagtttgcaaagaggctcccatgtgcagcagtggaaatgcaaacaaagctgaggaccaagcagaggatttcattgtcagaatagttgagctccaaagaaggctggcgtgctgtatgaaggtctgatttttggctgggaaataatgtgaccttaatccatgtgataggaatatctggtttgattttttttttttgaaattttgtatattcagattcctctgaacttactggtcctgcagaaatggtccactcatccacattttgcattggcacacatttcttgtttgagatgttacaaaattctgtttcaggactgtaatactccttctccaaccaggatctgctcccacttcccactactactatagaattaagttacacctgctgaagatatgaaaaaaaaaaaagagcgagagagagaaaagagacttaaaaaaaaaaatcaaaggatccgaaagacctagctagcatgtaccactagaaaacaagagtgtgagggactgaattttgaagtcctttgatgatgagaaaatttattgattttggagcactgacctgaaataaactatttagctacttgtaaaaaactccaggacatgaggtaaacttgctactagaatgacttgtagaaacagggaaaaatcaatggactactctaagtgacattgaaatgtcagtattgccgttgcacactgtaaagcaatgggttaaaatactcagaaataggcttactggaatggcaattttatataagggcttagaatgtgtcagattatgttgcaggggaatatcacatgatatgccatttaccaagtgtgctaggaatatgttagtgagggggcaccaggaaatgtttgatggtggccctctgtgtaagccacttttgacagtatgagaagccattagggaactaggcttattgacagccagcaggacggtaggactctgaaacaatggtacttgattattgacagtcaactggatgcagttattgtgatatgtggcaaggtcaaaagggcacatggggagcctcacttgtagcaaattaaagaaacggcatccctaattatagaaattggcacctcaggggaaaaatgactgggcattaagcaaaagggacctactcatttataatcatttaatgaaagcaaaaatggatgaccaggaggctgagggatgtcactgtaaaaaaaagtcagcacctttttcctagattttagtactgagaatgttttttgacccagaatctccagactcttcgagtgttggaatcccaggttgaaatgtcctgcagcaccaatcaaagataaatatgtactgaggaaagggaaatcttgaaatacttggatgtgtcttggatacggggccattaataatgaaggatatggagaatcataatggcactcttattagatcgggggatttggaatacatgcaacaagcgaagtcttgtcccaggtttgactcctgctgtctccactagttcttgaatccatccagtgatcagtttcctggtttatgaatgtataatcaaaacagacataattggtagctggcacagggtttttggcctatggcatgagatcatgatatcagcatggcaaagggaaagtataagcctgtaataattctgcccccagcctcagccaaataagtaaattaaaaacaaaacaacaataaaaaaatcaaatatatattttttgttaagagcataaaatttattaccatttttaagtatataaagcaagctcgtccaacatatggcctgtaggccacgtgtggcccaggaaggttttgaatgcagcccaacataaattcataaaatatcttaaaacattatgagactttttttgctatatattttttttagctcatcagctatcactagtgctatcatattttatgtgttgcccaaaacaattattcttcttccaatgtggcctggggatgcccaaagactggacgcccatgaaagaatgtaggcattatagttttggacatacgctcaattaatattcaagacagatcccggagaataatggtagattatcacagtcataacgaaataacatccccaatcgcagccacgatgccagatgcagtgcctttgccagagtatactaacaaatacaacctcaggtaaacggtatgtggccattcatttgttgaaggtgttttttgtttgttttctggcttgcttgcttatctttgcttttatctccttatcagaaaaaaggatcacaagcagtttacgttcacatagaatggaaaatagtatatgctatatattaacatcaggggtatgcttactctcttaccatttgtattaagaaagtctatagagagctgcactgcctggttcttctgaaaatcacattgatccactttactgttcatatcatgttaattggtccaaatgaataagaaaggactgctaaattagagaccttattatgacccaagcctcagagggtgtaaaataagccctatgctgatgtgcctacaaaatcagttaaattatcaagagaccagtggtcagaggcatgttgaaatactcttccaaaggaaaaattaatatattttacattttacaccatgaagaagcagtagtgcctggtagcctattcaagcactggaggcagcatacgcaacatctggggacgctgctccacaccatacattgggtgatttgaaaagctgccgggtttgtgtgagatacagagcaggaaaggactctgcatcaggaccaggctaaagtgaaagcagctccaaagcttgatccataaatttcagacactgtgccattagaaatggaagtgatagaaaaagatgctgtgtggagtttatgggcatcccggatgaaaacatcaaatctgagggggctgtcagtaggcaactgcagcttatagctttttcatggatgcctcagcttcagagagcttctggaagcaaccagcatcaaatgaccatgaggtataacccaggacaactatgaaggatttgataaaggctgccattaagcttgaattgcagcacatttccattttagagtcagtttcctagggaattacaccatcaatattaataattttgtgggctttttaaatgttatttttttagtgcagttgattaaaataattgatattaaacccaatatataattgactgatatggtttggctctgtgtctccacccaagtctcatcttgtagctcccactggaagggacccagtgggggatgattgaatcatggaagcaggtctttcctatgctcttctcatgatagtggatgggtctcacgagatctgatggttttaaaaatgggggtttctctgcacaagccctctctttgcctgctaccatgtgtgtaagatgtgacttgctcctctttgctttctgccatgattgtgaggctattcaggccatgtggaactgtaaataaatctcttttttctgtaaattgccccatcttgggtatgtctttatcagcattttaaaaatggactaataaattgacccaagattagtttatagaaaactaaattctattaattggaaataaacacaattttccatatagctggatttttctttgctaatatgttaagatacttgaggtaggcctattaacaatcttactactattgccattattagattttgatttctagtttttataatcctgtaaagtaatttggaataattgcctcttcttctggtctcaggaaggtgtgatgttttattgttttgttttttttttaagttgtgaagctcggatttatttatttattttttaaatttttttaattattattacacttttaagttttagggtacatgtgcacaatatgcaggtttgttacatatgtatacatgtgccatgttggtgtgctgcacccattaactcgtcatttaacattaggtatatctgctaatgctatccctcccctctccctcaaccccacaacaggccccggagtgtgatgttccccttcctgtgtccaagtgttctcattgttcagttcccacctatgagtgagaacatgtggtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcattgttggacatctgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgacacactgacttccacaatggttaaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagcgatgtgagcattttttcatgtgttttttggcgcataaatgtcttctttggagaagtgtctgttcatatccttcgcccactttttgatggggttgtttgttttcttgtaaatttgtttgagttcattgtagattctggatattagccctttgtcagatgagtaggttgtgaaaattttctcccattttgtatgttgcctgttcaccttgatagtagtttcttttgctgtgcagaagctctttagtttaattagatcccatttgtcaattttggcttttgttgccattgttttggtgttttagacatgaagttcttgcccatgcctatgtcctgaatggtattgcctaggttttcttctagggtttttatggttttaggtctaacatgtaagtctttaatccatcttgaattaatttttgcataaggtgtaaggaagggatccagtttcagctttctacatatggctagccagttttcccagcaccatttattaaatagggaattctttccccattgcttgtttttgtcaggtttgtcaaagatcagatagttgtagatatgcagcattatttctgagggctctgttctgttccattgatctatatctctgttttggtaccagtaccatgctgttttggttactgtagccttgtagtatagtttgaagttaggtagtgtgatgcctccggctttgctcttttggcttaggattgacttggtgatgagggctcttttttggttccatatgaactttaaagtagtttcttccaattctgtgaagaaagtcattggtagcttgatggggatggcattgaatctataaattaccttgggcagtatggccattttcacaatattgattcttcctacccataagcatggaatgttcttccatttgtttgtatcctcttttatttccttgagcagtggtttgtagttctccttgaagaggtccttcacatcccttgtaagttggattcccaggtattttattctctttgaagcaattgtgaatgggagttcactcatgatttggctctctgtttgtctgttattggtgtataagaatggttgtgatttttgtacattgattttgtatcctgagactttgctgaagttgtttaacagcttaaggagattttgggctgatacaatggtgttttctagatatacaatcatgtcatctgcaaacaaggacaatttgacttcctcttttcctaattgaatacccttatttccttctcctgcctaaatgccctggccagaacttccaacactatgttgaataggagcagtgtgagagggcatccctgtcttgtgccagttttcaaagggaatgcttccagtttttgcctattcagtatgatattggctgtgggtttgtcatagatagcttttattattttgagatacatcccatcaatacctaatttattgagagtttttagcctgaagggttgttgaattttgtcaaaggccttttctgcatctattgagataatcatgtggtttttgtctttggttctgtttatatgctggattacatttattgatttgcgaatgttgaaccagccttgcatcccagggatgaagcccaattgatcacggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggattggtggtgatatcccctttataattttttattgtgtctatttgattcttctctcttttcttctttattagtcttgctaacggtctatcaattttgttgaaattttcaaaaaaccagctcctggattcattaatttttttgaagggttttttgtgtctctatttccttcagttctgctctgattttagttatttcttgccttctgctagctttttttttttaaagtttatctattttttctttaaaatcagaagtaattaacagcattactttagtgaacaatgtttatttatatagatctaagtatttactttgtattatttgttttttatgtttttgatggagtctccctctgtcacccaggctggagcatggtggcgcgatcttggctcactgcaacctccacctcccggggttcaagcaattctgctgcctcagcctcccaagtagctgggactacatgcatccgccaccgtacccagctaatttttgtatttttagtagagacggtgtttcaccatgttggccaggatggtcttgatctcttgacttcatgatccacccacctcagcctcccaaagtgctgtaattacaggtgtgagcctgtattattcatctcttacatatcaggtattcattctgtgatttgtattttattgcctaaaacatatctgttacaatttcttttgtttgttttttttttttttgccagtagtacaacctatcaacttttgttttatgaaaatatttcaaatttctcctggtttttgaggatgatttttctgtgtatagatttctaagtctggagttatttatattattacattgactatattacttcactcttatgaatttttattttacatgtgtctgataattccaatagcagaaggtcttttctttccttcctgttgttatatgcagatacacctacatatattaatatataaatgaatatgcatttatatgtgaacacagaaacgcagacacacatacatacatattcatttatttattttcttccttgtctttgtgccaaatggcttttgagtgagtgattcatttccaaaaaatttttgtgtcagaccattttcgggctcagaatgaaggagtaactctagcaggtatttgtgtatacttctatgcttcagaaggcactaattttaggatctactttaaactaaatcaatgattggatggttttccccacctaggtatggtgaacttcagctcagtgtctgccagagaggcgctatatttacactttctcaacatcatttccccatgctctgcttagcaccaaagagacttccgcttaatttaaagccacattccctgaaggctgatgataaaattttattctgggtttacgtttacactgagagtgtatcctttggatggtcacatcattaggagaaaggaatcttttattagactccacaatttaggtggctctgaaatttgtcttctggtcccggtatttttcctgatcttgaaaatcaatatttgtagaagtatccatgatagtcaaactcaaagaagcagaaaaggcaatagtggttgccagggcctaaagaaaagagaaatggttgtttttgaataactctgaagttccagttctgctatatgaaaaagtagagatttgctctttcacgtagtggctatagttaacaatagacaacatgtacttaagaatttatgagagtagatctcacgttaagtgctcttaccacaagaaaaaacaaaaacaaaataaaaaacaaaaggacgctttgagaggtgttagacatgtctattactttgattgtggtagtgctatcacaaatgtttgcatttgtccacactcatcagatggttcacattaaatatgtttcgttcttatatatgttctaccttaataaaactgaaagaaaaagaaaaacatcaatgctccatttcccttattttgtaaaataatttcataaaaaaacagcttcagtaatatttatatctcttggttgctactatcacaaatatttttggcttgataattactcactatcttgctagttttatgcttttaaaataagttaaaatttttttaccaaacaatttttattaatttcaccagaagatttgaacaggactactgtgtttttacattactagttttcctaattgtttttaagatttttaacattgcaatttttttcctaaatgcttattacctaattaacacttttaaatgttctttgagagtctaaatgaaatgtgtatactgtcttgggaataatgctatatatgtccattaatttgaacttgtcattttcatcatctcaatcaatacttcatatcctaattaatgtttcatcaaattaatctttaaatttctaaaagaaataagttaaattatttcactagaattgtgaatttattattcttatattaatcaatagtgcttgctttatacactgtaaagccatgagggtcagtggatttttttttatttcagattacatgtcttccttgtggtgtttgatcttacataaatttgaaatacctttttggggttattttccattgtttttattgttgtaaattgccagcgctattttcctcatgcttttatttttaaaattccagagtaattttgatatataatacataaactttctaaaaaatgttattttcttgagaataacttagctttctatacagggaacccagagactcaatatctacctggcgttgagctctggctcaaactaaaaaatttagcttctatgaaaaaggagcaaggaaagagtctttaagtaacctggctccccaaacagagctttctaattaataagctcattaattttactcaggtttttgttgtattctttggatctgtggacttgctacactctattttttataaaatgccattcccaatctttgattttcattacaaagaaagtacttaaactgtttcatgtacttatgatactctgcttaccacatcaataaatgtttatatataattttgtaatatatatatgcagagtatatatgtatctgtacgcatgcttatatatgtatatgtgtgtgtgtatatagttggccctccatatccataggtttcacatccatgaattcaaccaaatattaactaaaaaatattcagaaaaaccctccacaaagttccaaaaagcaaaagttaaatttgttgaacccagagtgctatgttaaatccatgagactgaagtaatgtgtaggcattatattaggtattataagtaatctagaaatgatttaaagtatagcataggatatatgtaagctgtgtgcaaacactgtaccattttatatgagacttgagcattcatgaattttggtatcattgggggtcccgaaaccaatttcccacagataccaagagataactccatatgtgtgtgtgtatgtatgtattaatatgtaattttgaggcattcaacacattaaagtagttataagttttcacagctgtcattttgatttaatatttaattattttaatatttggaaaaccattcataatgtatgtggtaaattatatggtttccttttaacaccataaatataaatgttataattttgtttattaacaaatacttttgttcacatttactactaaatgctcagcagataattttcctggattacagaagtttataatatttagagaaactttattggtttgcattaatgacataatagcattttaactgcatttatggacgctttctattattacttgcttttcaaaacaatataaataggccactataaaattcctggtatatattcttaactattgagttatctgtagggtttttaatgttttttccctcttagaatcaatcagtttcattgaagtattacaattcatctgtatatataaagcgtttattgaaaaatacttagattagaatttctgtgttaatagtagatatttttatgaagatctagagaaataaggcagttatttttagcaaagtaatcctagtagaattggtgaatcttctgaggagattaaggagcataaataaattaagtaatagttgggataaatgttgtcagcaaaatggcatagtagatgatcccagctttgtcccccaacaacatcaagaagacaacagctagacagtatttacaaaaacagcactggagagctcaggattccatttaagaagctgcagcagcatggtagagcaaaaaacctgggaatagctgttaaaagtaagtcagatgaaaattttcattttacctatattatgccatcccgcagactggcactgctcagcatgaaaaaggaaagtcctgttctgtgggttttccttgcaaggaaagggagagcaaatggatcagcagcttttccactcttttaaggcactgtccaaagaacctgcctcactttcagggcacccggattgctggggagatcagcatagctgagacatctggagatggcttgcaacaaagaagaaggacaagggctatcagtatcagccacaagagggtgccaccgtggtccctggtgacttgctctgcacaggacgccagcggccttcaccactgagaacatcgacagcggttgggctgcaacacacacttttctgcagctttcaccactaaagactctgcagcatcaaccaccacagctttgccaccaaaagatccagtcgtctgcctttgcaggctccagctgcctgagcctccatgcctcttccttactctacccaagagctgtccagctggtgccactacagataccctggcctcaagattcagcatggccactgcttatgcacctgaaaatggctcatacccacaccaccagccctggcctacagctggtccctgcaagcacttgcatacacattttcagccccaaaccccatagtcatggttatgattgctgctggcatctgcctccatggatgtacctacagtaggccccagcccctgccaccatgttcatgcacactgctaatccaagccactcttgcctttagccttagttctccactgctgggcccagaggcactgtggaggactccaacagccctcacattccctacagaccctccatagctctcaccaacaaggacctcacagttgccaacatcataaacatcagttgcgtgagctgacaaggcaccatgttcctccagacctagaagcaaccacatccctccacacatggtataaggtgctatagcactctctagcatgcctcccaacccctgcagttgaaggtctttctttaccaagcccagtccgtaagtcaggaagaggtgactgcttcttcaaatgtgcagatacctatgcaaggccatgatcaggaagaatcaggaaaacatgacaccagcaaaagaacacagtaaacttctaataactgacaccaaagaaatgaagatttggccaggcatcatggctcacacctgtaatccccagcagtttgggaagctgaggcgggtagatcatgaggtcaggagttcaagaccagcctggccaacatagtgaaaccacttctctactaaaaatacaaaaattagctgggcctggtggcaggcacctataataccggctactcaggaggctgaggcaggagaatcatttgaacctgggaggcagaggttgcagtgagtcgagatcacaccattgcactccagcctgggcgacagagcaagactccatctcaaaaacaaaaaaacagaaaaacaaaaaaaaaaacaaaacaaaaaaaaagaaaaagaaaagaaacgaagattcacaaattgcatcacaaataatttaaaataataggtctaaagaagttcagtgagctacaagggaacacagattaacaatttaacaaaacctggaacacaacaaaagaacaaaatgagaagttcaacaaaaaaaataaaacataaagaagaagcaaacaaatttctgagctgcagaatacaactgagttagaaaatgagagcatcaatagcagactcaaagcaatataataaataatagagaatttcaataccctactttcaacaatagatagatcatccagacagaaaatcaatagaaaacacttgatttaccctacaccacagaccaaatgaacctaacaggcgtatacagaatattccaaaagcaagagaatattttcccagatagatcatatgttaggccacaaaacaagtcttatgaaatctgagaatattgaaatcatatcaagcatctttctaaataaaatggtatgaaactagaaatcaatagcagacagaaaaattgaaaaataagcaaatatgtggaaattaaaccacatgcttcaaaaggctaatgtgtcaaaaaggaatcaaaatggaaataaacagaagtcttgagacaaatgaaaatggaaacataacataccaaaacttatgagatgcaggaaaagcagatatattactaaaagctaggttcatagtgaaaaacacctaagtgaagaaaaaagaaagtactcaaaaaaatgaaaaacctagctttacattgcaagaaacaaaacaaaggagagcaaaactaagctcaaagttagcagaaggaagaaaatgatcaacataggaacagaaattaatagagactaaaaagacaatacaaactgtcaatgaaactacaaattggtgtttaaaaatataaacaaaaatggcaaacttttagctaaactaagaaaaaaattgaaaaaactcacataaataaaatcagaaatgaaagaggagacatcatgaatgataccacagaaatacaaggaatcataggcaactgctgtgaacaatacacgtaaaattggatagcctagtagaaatgaatgaattcctagacccatttaacctaaccagactaaatcataatgaagtagaaaatctgaatagaccaatagtgactaaggagatagaatcagaaatgaaaaaatctctcaacaaagtaaagcccaggaccagatggcttcacttatgaagtctaccaattctttaaagaaacagatattaattctcaagttcttccaaataattgaagaggagggaatactttcaaacttatttttcaaggctagcattatcctgataacaaagccagacaaggaaactacaagaaaagaaaattgcagacgtatatcgttgatgaacatagatgcaaaaattctcaacaaatactataaagtgaattcagtagcacattaacaggatcatccagaaagatcaagtgggatttatcccagggatgcaaagatgctttaacatatgctaatcagaaaatgtaatagactacattaaaatattgaagaataaaaattgtatgatcatcttaatgtgcaaatttaacatcctttcataataaaagttatcaacaaattagttacagaaggaatgtaaatgtacgtcaacacagtaaaggccatatacgacaagcacacagctaacagcatacttaatagtgaaaagttcgctgaaaggttttcctctaagatcccaaacaagacaaggatgcccactgtagccatttttattcaacaagacaacctagccaaataaattaggtgggaaaaagaagtaacagacatcaaaaagagaagagcaaaggtaaagttattccatttgcagatgacctgatctcatatatagaatcctctaaaaactccacaataaaatctgtttgaactaataaaataattcaataaaattgcagaatacaaaatcagtgtgcaaaaatcagttgtatttctatacactaataacactaatagtgacctctctgagagataaggaaaacaatcccattgcaaacagcataaaatgcaatacaatatttagaaatatatttaaccaaggaaataaaagatctgtactctaaaaactataagatgtactacccaaataaatctacagattaaatgcaatccctttcagaattcccatggcatttttcacaaagcagaataaaataatcctaaaattaatttggaactacaaaaaaaatccaaataggaaaattaatctttagacacatagaataaagctaaggacatcacatttcctgatttgaaactatactttaaagctatggcactcaaaacaatatattactggcataaaaacaggcacatatatgaatgaaacaaaatagagcatttagaaataaactcactcataaggtcaactaatcatttacaaaggtgctgaaaacatatagtaggtaaagatagtcacttcaagaaatagtgtttggacaactggatgtccataagcaaaagagtaaaactggaatcttagtttgcaccacactcaaaaatcaactaaaaatgaattaaaggcttgaatcataaaagccctggaagacatatggaaaagtccccctgatattgatcttgatactgatttttttgtatgacaccagtagcgcaaggaacaaaagcaaaattaatcaatgggcttacatcaaactcaaaagctactgcacagaaaacagttaataaaatgaaaaggcaatcttcagaatgggaagaaactatttgtaaactatatatctgatgagttaataacaaaaatatacaaaggactcatacaactgaatagcaaaaaaaataaaaaaaaataaaaaaacttatttaaaaatagcaaaggacctgaatagacatttctccaaagactaacaaaaagccaacaggtataccacagaatgaacattttatttttttgcttagcaaatttattcactgttggatttttttaatggaaaaacatatcagctatttctttttcccctcattgtttccttctggagtgcttttttcccagtattactgaggtatgattgaaaaataaaaattgaatatatttatgatgtataacaatgttttgatatacatatacattgcaaaatgattaacacaataaagttaattaacatccatcaattcaataattactattttgtatgtatgtgtatgtttggggagtggggagtaagaacacttgagatctactctcttagcatattttaagtatacaatacagtattaactatagttattacactgtaggttaggcctccagaacttattcattttataattgaaagtttctttgactctttgaccaatatcttctcttttctgccacatcccaggccctaacaacccaaattctactctctgttacttatgcatttaacacttttttagattttatgtgcaaatgatatcatgctgtatctctctttctatgtctagcttatttcacttaacataatgttctatgggtttatccatgttgttggcaaatggcagtatttccttttttaaggctgaataacaatgcattgtgttctttatccattcatttgttgtgtgacacatagcttgtttctatattttagctattgtgaataatgttgcaatgaacacgagagtgcagataactctgcaagtatgtgattccttttccctttttggatatatacctagaagtggaattgctagatcatagggtagttctagtcttaatttttaaaggactttaatactgttttccataatggttgtgcattctcatctacagtaacaagggttcctttttgtccagttttctccaactttttttctttttgataatagccattctaacagctgtggggtaatatctcaatttggttttgatttgcatttctctgataattagtgatgttgagcactaatcacatcacattttttaatggtgctgggataactggcctattgtttttgatagctttgtcaaagatctgatgactgtagatgtgcagaattatttctgggctcttattcggttgtattggtctatgtgcctgtttttgtaccagtaccatactgttttggttactgtagcactgtagtatagtttgaacttgggtaacataatgctttcagcttatacttttggcttaggattgccttgcctatttgggctctttatctggttccatataaattttaaaatagttttatctttttagttttgtgaagaatgttattggtagtttgataggaatagcattgaatctgtaatatgctttgggcagtatggccattttattcatattgattctgcatatccatgagcatggaatgtttctccatttgtttgtgtcatctctgatttctttgggcaatgttttgtaattctcactgtagaaatctttcaccttcctggtgaactgtattcctaggtattttattctttttgtggctactgtgaatgggattgcattcttgatttggttcgcagcttgactgctgttggtgtcaagggatgctagcgatttttgtatatttattcaaaagttcctttaatgaatcagcaaacatacaacttaaaactgcagtattgtatgaaattaatttagtatgttattctttttgagtatttgtgcttatgtatttctattcacatatcaatatacatggcaattatacgtggcatttgctttcttcacaactttcatttgaatattataattcaaatgttgaagtattatttaatttataatttaatgcaattgtaagtacatgaacatattttcaaattaataagttttgtaaatgttacaaatttcaatgaaagtaccgatcaaataatggatagaagtgtaaaaacttgcttgtgatatattacagtttaaaatacacctttatgtataataatggtaatacaattacattgtcacagaatcattagttttgttttgcccattgtccctatgctttagagaaaacaacaccagatttctgacactcactcagtagtgagtgtcattacactactaaacatagcattcaagcctcgaaaatggaatcttgaaatccactagttttgttgcatgtacttgtaagacttaatgcaatgcatgctactaaaaagttttctatgcttaagaaattaacttataaaataaaaagtttaaagacaagcaatcatttaagaaaaaagtagatttttatatttttttcccaaaaatatttgagtataaattaagggacactttacttttaatatctttagttttttttaaaaaaaagtgtgcttgatatacacatagatatgtattattaaaagtaattcttctagctatatgctggaatcttaatttctgatactttatagaaatatttattcatcaacagtattactatgtaacattaaataggtgataacattagtttcttttaatttttctttttacttgctgttatgctttctctccttgtgaatactgaagatgtaccaatacaaatatttgtatttttctttaatccagttcagctagacaatgtcttaatctatagttttggtttgttttaccaaaatcctactaagttttagaaagcatgattttctgaaatctcaaataggtaaaaatggccaattacttggttttagcttttcttcagtaaatttcatataatacagataagattatggatattaaagtagactaattttaattaaaatatctatacttcttgaaatacaaattatataaaggagaataagataaagctctcatttacaatatgatgtcagtatatgattttgcatattatataggcaaacatgaaatctaaggtatcacaacaaattttaaagtaatacacgtactttaaataattaatatggatatatgtggctaaaggacaaacactaaaagaagtaaagtaataaacacggttattttgcttaaagaataacagaatatagctagactcttgaatttgtaggttcaagatatgaaagatatttatactatcaatgttaattaagaatttgcattgcttttgatgttctttaaaattcaaaatatataatgtaaatatctaaagagtatataattttaattatcaatagtttacttattctaaatgctagatattcaaatgcctccctacttcattcaatctaagaaattaattctacttttagcagcatgtttacagaaatccatgctataaaggcaccagcttataagacaggtggtgctatctgcttatatatgaggaataggatcaagaataaaaggttgaatttattaaagaacagcaatgtacaatttgtcctcaaaagtaagtagccctacattttaaaaaaagctgtgctttaggggagctcagggaataatgggtgaaatgtgtgaaatgtcaagaataattaagaaaaatgatagtgttaaatatcagcaaaggaaatacatctttcctcctacaatcttctcttcctattttcttctttacttttaaatgtcatctctgttctcaaattatttaggatagtgcttgcaaaagggtagtgtaatttctaggtaatttgacatatccccttgataaaattgttgtttggatatttctttatttgtgcttcatttaatatgagtccactattttgtatgacttaaatgggtcaaaatttaataaaatcatatgaaaggtgtcagctttccaagggaagtagcttgatttatctttggatttttttaacctcatttcataaagtctttttttataagtgatttacatgcaattctttcattttatatatgcatatatataattataaatttaaattgtaaatttaaatttagactaacaccataatgagatatgccacagagtaatttacattcattactagttaattgtaccagttaatccatatattagggaaagttttgattttgttctttaacataaatattaaaaccacacatttttaacttattttctctaatgagtaattagagctgaaagcatgtatttaaacaattgaaattcttctgctttgatgaaaaaggacaaaactgttcacacatttcttagaactaattcagacacttggaaagaaacaatttaaaaatcaatttttataagcttatataagattaaaatatgcgatattaaaaactcaatgtccctgatgtgattctgtcctgagcgactgttctcctgagcagtggtcgtttatctccatctgccttctcccctacctaagtgcgtgccgccacgcgatggaagattcgatggacatggacatgtcccccctgaggccctagaattatcttttcagtagtgaactaaaggccaacaaagatgatcactttaaggtggataatgatgaaaatgagcaccagttatctttaagaacggtgagtttagcagctggtgcaaaggacgaattgcacgttgttgaagcagaggccatgaattacgaagggattccaattaaagtaacgctgacaactttgacaatgcctgtacatccaatggtttcccttgggggctttgaaataacaccaccagtgctcttacggttgaagtggggttcagggccagtgcatattagtggacagcacttagtagctggggaggaaaatgcagagtcagaagatgaagaggaggaggatttgaaactcttaagtatatctggaaagccttctccccctggaggtggtagcaagtttccacagaaaaaagtaaaacttgctagtgatgaagatgatgatgaagctgatgatgatgaagatgatggtgatgattttgatgatgaggaaactgaagaaaaagcgccagtgaagaaatctatatgagatactccagccaaaaatgcacaaaattcaaatcagaatggaaaagactcaaaaccagcatcgacaccaagatcaaagaacaaaaatcctacaaaaaacgggaaagaactcctaaaacaccaaaagaaccaagtgctgtagaggacattaaagcaaaaatgcaagcaagtatagaaaaagtggttcccttcccaaagtggaagccaagttcatgatttatgtgaagaattgcttccggatgactgaggaggaggctgttcaagatctctggcagtggaggaagtctctttaagaaaatagttcaaacaatttgttaaagttttccctcttattttatttctgtaacagttgatatctggctgtcctttttataatgcagagtgagaattttccctaccatgtttgataaatgttgtccagattctactgccaaggatgtgttgtccaaaatgcctgtttagtttttaaagatggaactccaccctttgcttggttttaagtatgtatggagtggtatgataggacatagtagtagtggtagtcaaacatggaaatggtggggagacaaaaatatacatgtgaaataaaactcagtattaaaaagaaaaactcaatgtattacctttaaaatttaatcaccatgccaaacaattcaaagaaacaacataaattatttgaaaatgaaaattttgtcacagatgagaaatgaagccacaagtaaattggcagtaagcaatgaaggaaagaaagtgtgatggcagaattatttgtttcaactagatgttggttttaacttgctgaaaagttattgccagagtcaaaagatatgcaaattatttgtaattattatgggtgtataatagttttatgtagttatggggtatttgtgaaattttgatacaagcaaacaatgtgtaataaccaaatcaggataattggagtatctatcacctcaagtattaccatttcttttctttgtgttaggaacattgtaattccactctattagttattttaaaatatgcaatgaattattgttaaccatagtctattgtgctaccaaacactaggtattcattctatctgactgaatcctggtacccattaaccatcctctcttttttccctgctctccacactcctttccagcctctgggacccatcattctctgggcttaatgcacaaatctgaatatttgtttaaaactatatttaagtgtggtaagttttaccaacacgtgtatgcagtgtttattaattcataaatatatgataaatttaggacttaaataaacaagaataatgccatgaaaggtctcctatttcatggcaagtaattagattttttccatgtatttcatgagatatttaagaggttttagagtatggagattgtggtagaggtgaagggtatatatttttttctctaggtcacgtttgtgaccttgtgtgtcacaaaattgacacacaagttctaaacatgtaactatgtggatgagaaatgaacaaagcctgaattatatttttagagggtgacttagagaaaaatatatacattcgtgcccagagggagtctatagagacatttttctacagaggaatgcaccacataatgatttttcagtcaacaacagattgtatatactatggtggtccctaaaattataatggagctggaaaattcctatcacctagtgatactgtaacagccataatgtcctaatacaatgcatcactcatgtttgtgatcatgctgttgtaaacaaacctactttgataccagtcctataaaatatatagcacatacaattatgtacaattcataatgcttgatgataatgagactatgttattggtttatatatttgtcatattttatgtttttattttatgggtattccttgtactatttttttttttaaagttaacttaaaacagtctcaggcaggtcctttgggaggtattccagaagaaggcattgttatcataggacatgacagcttcatgcatattattggccctgaagactttccagtgacacaagacgtggaattagaaaacagtgacattgattatcttgatactgtgtagtcctaggctaagatgtgtttgtgtctttgtttttaacaaaaaagtttaaaattaaaaagaaataaaaatttagaaagacaaaaccttataaaataagaatataaagaaatgaagtattttagtacagctgtacaatgtatttgtgttttaagtgaagtattattataacagagccaaaaaagttagagaaaaaaaaaaaaaaggccaggcacggtgactcattcatgcctataatcccagcactttgggatgctgaggtgggtagaagacttgagctcaggaattcaagactggcctgggcaacatggctaaaccctgtctctgctaaagaacacaaaaaagccagacccggtggctcatgcctgtaatcgcagcattttgggaggctgaggctggcagatcacttgtggtcaggagtttgagtccagcctggccaacatggtgaaaccctatctccaccaagcatagaaaaaccatccaggcacggtgacacatgcctgcaatcccagctactggggaggctgagacaggagaatcacttgaacttgtgaggtggaggttgcagtgagctgagaccacaccattgcactccagcctgggcaacagagtgagacttttgacagagcaagactccatctcaaaaataaataaataaataaataaatataaaaaacacaaacattagccaggcctggtgttgcatgcctgtcccaggtacttgggaggctgagacaggaggatcgcttgaaactgggaggtggaggttgcagtgagccatgatcatgccacttcattccagcctggacaacaggatgagactctgtcacaaaataaataaataaataaataaataaagttacagaaaacaaatttataaagaaaaaaaaattaaagtaagctaaggttaatttactattggagaaagaaatttaaaaaaataaatttagtgtaggcaaaatgaagtagtgtatagcaatgtgctaggccttcaccttcactccccactcactcactgactcacctagagcagcttctagtcctgcaagctccattcatggtaggtgtcctataaagtagtaccattttgtatcttttgtattgtatttttattgtatcttttctatgtttatacatatttagatacacaaacacaaattgtattataattgcttcaatattccatgcagtacatgtggaacaggtttgcaggctaagagcaatgggttgtacaatatagcctagatgagtgacaaactataccatctaggattgtgtaagtgcactctgtgatgtgtgcacagtgacaaaatcacctaaggatgcattcctcagaatgtatccccatcattaagcgacaaatgactgtatttgtcttgtcgctaattggactgagaaaaaaattaaggaattaatggaagagaaaaaaataactaatattcatttcttttaaatgatagtattaagaaatagtacctcaggcagagaatgatgatatcattatctttaagccttcatggttgcaggtttatgtgccccttcaattttgtaaaaatgcataaatatgatcatatcatacaaaatgagtttcttttaattgtagttttatctttatatttttatttgactctcccatttctcactctcctctcaagcaaatcatcactttccctacacctgtcccttaacctatttaacaattttcaaaatgtaaatatgcatatacacacataagcatacaaagatggatgctcatctacatatacaaggttcattttatgtcattgtttttaaaaaatgagaagtatgcacactattctgaatcctactttttctctcttagtaacacctttggaatccttccaagtcaattctaaaaccttttagtcatggttttaaggggtccattatctctctatggctgccttttgtgaaatgtgtcatacttttaaaaacatacattcctccattgattagcattgacattattttctattattccacattactagggtggctgtatgtatttgtgtgtacatgctagcctaattttacagtggaagttgcatttttttactctcaaaatatcccactgcctaactctgttgctggggagatgtagtagtgttttgaaaggtaaaaaaaataaaactagctaggagctttaaaatctgaagatgggcatggcagagaagcctctgagttttctttttactactatatcatagaataaatgctggagaagccagtaacctggaacaataatagctacagacacactcatacacacacacacacacacacacacaaacacacacacaaacagccaactaaacataagtctactctttccagccaaaagaacagaaaacgggtaatctaacaagatacaaaacctttagaccataattgctttccagcagccaaagcccacagaaataacagtggtcctacactcaatttcaccacaaaatgtcaagtgttgaggctagatttccagccatgccacatttcaaggagacactcaaccactcctcgccctacctcccaaaccaaggcgttatctgagaaaatcaagtagggagtcaggactatcatccaaatgtgtaatgaagccccccactgtggaatcagtggagaccacatgggaaatagtaacaaggtgtcttccaggcagggaggtatcagtgaagtcttcatggagaggagtactcacactgtgccagaaataatgaaaagtccatcacttataatgtcaacagaagctgagtagggaaccaggaattccacctgtcctcagcattaacaaagcaccaccctctacctgctaccaatgtgctatcaaaagaaggcagctaaaattaaaattttacttaagatccagagtctcataacacagtaccacctttcacttcccccatcccctgctctgctgccaaaaaaaaaattaacagtgacacttggacctttgggactacaaccaaaaaaaaaaaaaaaccaacttctgtgtcatcccagttcttaaaggagaggagaaaaagagcagggacaataaagcataggaagaaatcacagctaaaaatttcacacatttgaaagagacatagacctatagtttcaaaaatcagaacaaaacccaaacagaataaacctaaagaaatccacaccaacgcacttattagtcaaacttctgaaaactaaaaacaaagaaaaaatcgtgaaagtagcaagggagaaatgacagcttacctttagtggaaaaaaataagttaaattacagaggatttctcatcagaaaccatggaggctagaaggaaatggcatgacattttttaaatgatgaaaggaaataactgtcaacccagatcctatatgcagcgaaaatatctttcaggaataaagagaaaatcaagaaattctaagataaagaaaaccataattcaacacacattcatgataaaactcagtgaactatagaggataacttttccaaattaatgaaaagcacctacaaaaacatacagctaagattattctttttttttctttttttaattatactttaagttctagggtacatgtgcacaatgtacaggtttgttacatatgtatacatgtgccatgttggtgtgctgcacccattaactcgtcatttaacattaggtatatctcctaatgccatccctcccccctcccccccaccccacggcaggccccggtgcgtgatgttccccaccctgtgaccaagtgttctcattgttcaattcccacctatgagtgagaacatgtggtgcttggttttctgtccttgtgacagtttgctcacaatattgctttccagcttcatccatgtccctacaaaggacatgaactcacccttttttatggctgcatagtattccatggcgtatatgtgccacattttcttaatccagtctatcattgatggacatttgggttggttccaagtctttgctattgtgaatagtgccgcaataaacatatgtgtgcatgtgtctttataacagcatgatttataatcctttgggtatataaccagtaatgggacggctgggtctaattctagatccttgaggaatcgtcacactgtcttccacaatggttgaactagtttacagtcccaccaacagtgtaaaagtgttcctatttctccacatcctctccagcacctgttctttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccacttttttatggggttgtttgaatttttcttgtaaatttgtttaattctggatattagcccttcgtcagaagggtagattgtaaaaattttctcccattatgtaggttgcctgttcactctgatggtagagtttcttttgctgtgcagaagctctttagtttaattagatcccatttaataccacacatctacaaccatctgatctttgacaaacctgacaaaaacaagaaatggggaaaggattccctatttaataaatggtgctgggaaaactggctaagattattcttaatggtgaaaaactgaatgctttctccctaagacagggagcaaggcaggatgaacccgaaaatggaccagacaaataggccaaagcaatgtaatggagaaaggacaatcttttcaaaaattgatgctacagcaattgaatatccaagcgcaacaataataacagcaacaacctcaacctaatttttatgatttatacaaaatttaactcaaaattgaccacaaacagaaatatgtcttttgcggcaacatggatggagttggagtccattatcctaagtgaactaacacaggaacaaaaaacaaaaaaacgaataccacatgttctcacttataagtgggagctaaacattgagtacatatggacacagggggatactacagacactgggatctacttgagggttgaggatgggaggagagggagaatcaaaaaaactacctatcagatactatgcttattacctgggtgatgaaataatctgtacaccaaactcccatgacacataatttacctgtataacaaacctgcacatgtatccatgaacctaaaattaaaattaaaaaactaaaattggatactggtagagagaaataaaattttaaaattatatctattaggaataaataggagagcatttttaggatctaaagtcaggcaatgctgttagacatcatgtcaaaaacatgattcataaaaagaaaaaaatggcaaattgaacatcaaaattatatactctgctctgcaaaatcccttttaataaaatgaaaagactacctagagacatagaaaccgcatggccaacaaaagactagtatctagtatatattttacaaattcttactatgcaaaacttaagttagaaaatgagaaaaaacatgaacagatattttagaagtggatattctgacaagcacaggtaatggtcttcaatatcattaatcattagaaaattgcaaattaaaaccaaaatttaatatcacaacacacctacctaaacagataaagtaaaaaacaacgacaatactaaatgccagcatctatatggagacactgatcacgcagatattgctgatgggaatgtaaaatgttataattattctgggaaacagtttgacattaaacatgcaactaccatgtaatacagcatttgtactcctgagcatttatcccaaagaaatgaaggcttatatttacctaaacacttgtacctgagtgcttatagaagcttcatttataacaaaggtagttcaaaaactagcaacaacccaaatgtctttccaataaactgtggtacatccatatcacggaatactactcagctttaaaaggaattagtgatacgacaacttgcatggatcttcagagaattatgctgacagaaaaaaaaatcaaccccaaaagtttaacaactatacgattccatgaatataaaatatttttaggccgggtgcggtggctcatgcctgtaatcccagcactttgggaggccgaggagggcggatcacgaggtcaagagattgagaccatcctggccaacatggtgaaaccccgtctctactaaaaatacaaaaattagctgggcgtggtggcacatgcctgtagtcccagctacgcgggaggctgaggcaggagaatggcttgaacccgggaggcagaggttgcagtgagctgagatcgcactactgcactccagcctaggctactaggggaaaactccacctcaaaaaagaaaaaaagaaagaaaaaaatttaaatggcaaaattataaaaattagaaaccaattacagcagctaggggtcaaacaaggtgtgtggatgggagttaagcaggtgtgactaagaaactacaacatatctgatctttctggtgaaggaaatgttctgtatctttgttgtttctatgttagtatcatggttgtaatcttgtattatgcttatgaaagaagttaccatggaggaaatggggtaaagagtacaaaggacctttgtacatttttcacgagtgtgtgtgaatcaacatttgtatgaaataaaacacttaactaaaaaaaaaaagtcaatacttggttttgatacatatcaagggaaaaaaatatattaataagaggccaggcaagctggctcatgcctgtaatcccaacactttgggaggccgaatcaggcagatggcttgagtctaggagttcaagaccagtctggccaacatggcaaaaaatacaaaaattagccaggtgtggtgtcacatacctgtaatcccagctacttgggaggctgaggcaagagaaccacttgaactgagggggcaaaggttgcagtgagccaagattgcaccagtgcactccagcctgggcaacagagccagaacctgtctcaaaaaaaaaaaaaaaagaaaagaatagtttctctgtgtggatggtcactcagtcatattcttatactacttctaaactattttgcaaagagaggccttgtctgttatttccatgatgtagatttctacaagtgggatcagtaaattaaacttgttatattttaattgattttaataaattgctttccaacacttagtttccctgtagcaatgtataaatataccccctaccatcttcacactatgcaaaataaagtttgttattcattcttataatctgctaatctgactgttttcttgtctaaatgttttaaattttctattcttatgtttgatggccagatggattgcctttctgtatcttagtcatagcgctgcccattctatgtttaattttgtcttctcttttattaacttgtaagtgctttctgtatattatagattttgtcctctttgcatgaatatgtactatatgtaattttttaatccaagtttattactcacatactgcttttgtttatgctatcttttaccaaactaaagttgaaatttgtacacaataaatatttttttcttcttattttacagtttttaggcttcaggttttggataagagatcttccttcttacaccaccctcaaacaaccactcatagatttattaaaatatttatgttatacatttaaaattgtattttaaaaactatatatatagataggtaaaattttacctttttctgggtaaatattaagttgtgcaaaaaaatcactaaataaatcacacattattttctcattgtattgaaatgccttgtttgtagtatcttattttagtactataattaatttctgaattttctgttctgataatctattcatataacaaattcatatttatttgattacatttccaaacattctagtatcttgcaaatcaagtcttctctccattggtttttaactttttttactctcattctctttcaatttcacaataaataagttacattaattctatatgaacttgaattcaattcatacaatcatgtaagtacctctaaaattaacatttcaagaactggtaaatttggactttttttttttttgctcaaataatatttttttctggaaacattaaaaaaagaagtttctgcccctagtgttacacaagtatctcctttcaaaccaatcattctgtagataacatctcaactccagacaaacaaacagctgtctaagggcattggacagcaaccaagggaaggcagatactggaaggaagttgaaacctcgaagaaggaaaacatcactggatatatttttgtgtggtttttatttttttaatggcttttagtcttaaactacaacccagaatatgtcatgtgggtggctaaaacttggatataaaatcagcggtcttgcttttggagtactagagaacaaagttgagtttctcactgaaacataagagagaaatgccagataggaggtaaacagagaggggcactccaaattctgagcataaattcagtccatccctgagattatgaatcagtcacacatgtttatggcagtttcaagcaacccagataaagctaaggctaattaacaaaacagatttttgctgccactcacttcacaagggtcaggagtttgcaatttgagttctgtcaattgtatctggattttgtttatgatattttggagagtcataagattctgttatgttcctccaaacagcaccccagtgtgtgtgtgtgtgtgtgtgtgtgtgtgtgtgtctttttctcctctttcacatacactccttggagaaacattacagaattttgagtgccatttatgtacctaaatataattttataaactatttttcctttgactttgtgtttactttattacttgaaattatttagctttgccgttgataatatactggtatcaatattacctccttgtctttaagataattattcctgtaatagaaatgtattacctgttttttatatatatttcataattacctaaccatattatgaaatattttattgctttatttaaaaaaaaaaactttgtctgctgagttgtgtagttatatgattctaatattagcataaatgattattttgttaatgtatgcatgagatagttttttttttagcctttccaaagttgttataatactgacgaacctgtttactgttattgtgactagaggcaaccttcaaacgtttctgattgtaacagatcattttattgttttgctttttacaataaatattttttactcttatggaagataatcttctattcctatttttcatagttcattcattgagaaagcttatctttgtcaaattgcattattgagtttattatcatatgaattttcatctttaattgttggagagaaatagataaacagatagatttctgataggtaaccaaattatactcagataataaattctgcttgaaactagtatattacatgctgtcttgcgttacctgtactggtttcttaataatcaggaaattgtactcattttggttcatttttattgactttattgaggtacaatttacctaaaataaaattcacacatattgtgtgtaacagttcagtgggcttgaaaaaatttatttaccagggttatattatatcaagttataacacttttccatcaacacattaagttttcatttacattttggtagtaaatcttcatccccaatctctacttcaaacaccattgactggatctctaccatagttaagtaaatctacttacagaaattcagaaaagataatcctaccaagataaaatcttggtagattttacacagcgtattccttttggaattcagacacttagttttgtgtatcagtagttcgttttttttattcatggcttattagcatccctcaatattaatataccatggcttatgtattcctttgttatttttgttatttaggttgtttccagtttcaactgttaaatataaaacttataaataattatgcataggtatagtttggccaaatgttttcattttaaaaattattcctaggagtgcaattgctgggtcctatctgccaaactgtttcccaaagtactcatgtcattgtctacttacttttacattggtgagagttctagttgctccacatgcaagcaaacaattatcatcagaatttttaatttttgccatctaatgaatgaagatgatattttattgctttttaatttgcatttcccttatataatttatattacacattcattcatttggttactggacatttattcgtaatgtattttttgtagttattggttcaagtctttcattcattcctagtttttttttcacttactgatatttagccataaaaatgtttcatgtactctggacacaagtcctttaacagatatatgtatggagaaggtttatcactggctgtgacttgtcttttcatttattttaaaattgtatcttttgaaaagcaggtggtttgaatgtttatgttagttcagtttatcattttaaaacgttaatgttgtattctgtctaaataatctttgtctgccatatgtggtgaagatttcttcctctattttcttctagaaattatagcatttttcctgaagtatgggttgaggtacattttcttaaccatatgatccagttgtttcatttaaatgtttttataaagatttttctatcttcatgaaattctattggcatcttttacatacatctattatgttttggtttattattaattatgttggattatagtcaaagagaaacaccttagaatactagatgactctttcactatttttctctcttttaattttgttgcattttttataactatctaattgacttatcataaatctcccatgggtttttgatgaagttgattattctgttcaagtaatttctccataagaaagtaactagaggaaacaatcagttaactatattgtcaaatccttccatttcttttctttttgtgtacagtgtttcttaaattcttagaaaaatgtatcaaaatcttgcatttataaaatttttattttagatatttagcatctgtgtttttctacatatattatattatgtgtgttctaatatcctcaaaatctacatctcttatcacaacatattattatttatactatttgatatttttaactttaatttcactctgatattgatttcacaattatctttcgtattcacatatcttttaatttcttcatttatatattttaaaacattgtcaattatgtctgatgtagcacttaactatcttcttttgctatattatttaggatagctaacactgtatttccatctattatacataggtaaaagtaggggacaatttcttacataattttgtcttccagagctacaagatatgtctatatgcctcctcttatttttaagaacttgcccccttctgtcaaacttaaattgtcctctgccttaaaattacagtcaacataaaatataccgaaatacatgactagatccttatggtagtgactcagttctttcaactcaccagttaatttgagatggaatccaagcattccctatgacaatatttttcacattttattaattaattgttaattaatgctcttaatctgtggaaaatgttaaataaataaatgttaaatcaaagtctctgacaacttatgtggaaagtaaaacttcaaaatttttgaatttatacactgtcagacaaactgcaatatcaccagagacttcttcagtcatattcagaagctcaaaagattttcaaggtttttggttctctaaatagggttgacatcaagttgcaataatactgaatgttcacatgcttttgaatacatcacaggaaagaatccacaccctgattactaaatgcttaattttaatacttatcttgtccttctttaaatgtcttctttcttcagaattgaaagtgtctcaaaaagtcatttgggtttttaaataacgctagatgaataaaagctttcctcaaaaggttaaaagaacccataacttctcaagttgagaaaacacagatgattccttttggtaattgttaaaggtcatattttaacctagtgcctcaaactgataatagggaacagcaataagactatagctgaaggtcataacatcacacggaactcaaagtacattacaataaaatcaattaaatgtgatatttttctttggaaattattgggtttaaccaagttgaaacctccatgtttgatgtgagtgttttgaaggagatatgtagctgacagtattgtggcaattacagtaaagaagagaaagaagtttggtggattataatattattcagtcatttttgtatttatataatttatttagtttatatggaataaaagtatttatattttttaattttaaaacaatatcttgatcagtttttttattttaaaaatttttttatagttttttttctttcttccataacatttgcttcctgccagatacaatatctgattaactgctctggcaaaagctctccaaagtgcaaataaaaaaattccaaactccaattatgatgcggcttttctcttggcacatatgttctagtgtttgacagcacagtagggtgactatagttaacagtcatttcttttcaaaatagctaaaacagaagatttgaaatgttcccaacacaaagatataatgaatatttgaggttatttgatgattacacattgtatacgtgtatcaaaatagcacacgtaccccacaaatatgtaaaattactattcatcaataaaaaataaaattaaaaaacatacaataaaaattaaaaacataatattcaactaaactcaaccccaaaatgaagaattgtgttaaagttgtgacattttatgttcttaatacagaatttattattaattttgataccaatgaaaaggttacaagtggaaaagtaatagtgaaatagatattttctcaaaatacttgataatttgttgtatctacagcagaagagtctaataattttactggcttataattattctttatgtatccagtgagacaggcatttttatgagaacatgtgatgatgtcaaactagggctttgttgtcaaagtttaccatataaattggaaatagataaggactaacacatatcttcttggctttccttacctagcttgccatattttagtctataatatacttcaaaaactagcttcagaggccctgaaagtgtcttaaaataattgtcaaagaataggtgcagaatggcttgtagcaaatgatttgaaaatgaaatggggggaaaagagacataatgacatgatattatccaaaatataagagagaaaaataagagagcaatgcaaataagatgaaattaattactttctagtcctcaagtcttagctaaaaagcagatctttagtaatacaattgttactaaaggaaaggcaaggggaaactttttatgggaattttttttctattttagtgctaacatgaagaaatccacgtcgtagtctccaaattataggatagcatgtggtcagcaatcatctctggggaagggagagaataaacaaatactttccattatgtgttagaaacatccctggatacttaaaaagttttcaagttttactgactgagcgcttatttcacagaattttatttaaattatagtattttcttctcacaaaatcccaggtcagaagaaattgagactaacaggagtcaatatttcaaagtttacatagctaataaatagaagaataattactcaacccagttatatatttttaaaacttttcattgtggagttgcaaggaccaaatgccaggagcttacttttgaagcaggaaggaaaccctcagagcaaaagttagtgcctgcaattatatgctgattgtttctgtctcttctaatggctcaatcaacaccatttctcctgttttaacctgtgcgcagacatgaccttgtgggttgaaattgggagttcattaaaaaaattattggtagagggaagttactatgacctaaatatatcatggtcaaaatgtataactgtgaggcagatttgatacaccacattttttatcttgcttgtgatttttagttccaaaattatttatagattgatatttttgtctggtctcagaaagccaaattttaaggattgccaataaagttgtattaatactagtaataataaaataataacatactactaataaaagtcatcaaataataaactcctctaataaatccagaaaaaataaaagtagaaaaaataaaaatttctactcccaataatgagggtacattttatatcagaccaattgtgttttgccaaacacaattgcaaattctggatagaaacaactatttgaagtgactaagagtaaattaatgcaggagaaaccagaaaggactccaccgtgacagaaagaaaactgcacggggtaaaatttttacacagcactttgcttgaaggcgctctccaaaccaagcaatacaagatgtatagatgaagaaagtacaacattattacttgtttaaagatccaaaggatgaaatttaagattcccagggaatctaaaaagtaagagaaaaaactaaggaagaaattgaaacaagaggaagaaaccccatgttctgccttcaaacatttctctagtcctttgttaacatcagaagtgtgcaagcatgggagagactccaatcgtccaggcaaaacagctacagccagaatttaaaagaattgaatagtttcaactgctgcccatattaagcaagacaatttggagtggagaaattaggtcaagtaaactactagctagaaaagaaatcagcactcctcagagaaggaacaaatccagaatctctatgatgtgtccttttcaaagaaaaagagtttaaaaatatggaatataatcattcatagagattagcataaattaaaaataactattatactcaaggacttgaaaaatgtttatttgaataaacatatttggaatctctgcagaaaaatgcaaacaaaaaaagaaaatgatcctctcactttaatagacttcaacttttaaagcagtattacatttataggaaaattgagaatatagtacagagatttcccacataccaccttacccctctcacaataccccccattttcttaacatcttgtgttattgtagtacatttgttaaaattgatgaacccatattgatacactattattaactaaagtacgtagcttacactagggttcgctctgttgtacaggtctattggttttgacaaatgcataatttcatatattcaccactaaagtctcacacagaatagtttcagtgtccccaaatttcttgaattttacctatttatcccttcctttttctccctacaactcctagcaaccactaatctttttgttgatccatatgtatttttccttttccaggatgtcatatagataaaatcatacattatatagccttttcagaccttttcttttaacttagcaatatgcatttttggttcctccacatcttcttgtacattgatagttcatttctttttatcatctttttatccttttatcattgatagctcatttctattttgtgaatgtaccacagtgtgcttattcattcgtctatatatgagggatattttggttgcctccagttttgagcaactatgaataaaaccactataaaaaatcatgtgcatgtttctgtgagcaaaataagatataaaaatggccaggtccggtggctcatgcctgtaatcccagcactttgggaggccaaggcaggtggatcacgaggtcaagagattgagaccatcttggccaacatggtgaaaccctgtctctactaaaaatacaaaaaatagctggtcttggtggcagaagcctgtagttccagctactcaggaggctgagtcaggagaattgcctgaacctgggaagtggaggttgcagtgagccaagattgtgccactgcacgcctgcctagtgacagaccgagactccgtctcaaaaaaaagtatatatataataaaaattttataaataaaaattatagtagctgaaataaacctaaaacaataaacagctgtaactgtacagaaagacagaagacatttttagtgagtttgaatagacatatagttgttactggatctgaagaacaaagaggaaaataattttaagtagagactcaagctcctataagacaatataaatgtatctaacttatatgtaatttgattatcagaaagagagttaaactgagatagaaatatatctgaaaaaataatgatgaaaatttcttcacgtatggttaaaaaaaaaaaatcaatttacaaactcaataagctcagttaaccccaagccgaattaagaaaaaaaaaaaaaaaaagaaaagaaagtcccatctaggcataataaccaaattactgataaccacagatgaaaaggagaagatattgaaaggaaccaaaaaaaaaatgcaacattacacaaatgggaaaaatggtaagaaagatggtcgaattttcactagggacatgggatcaaatgacaataaaaaatgctgaaataaacggttaatgccaaattctgtgcccaactaaaaatgttttaaaaataagacttgatatggtttggctgtgtctccacccaaatctcaccttgaattgcaataaactccacatgtcaagcgtggggcctggtagagataattgaatcatgggggccgtttccccatacttttctcctcatagtgaataagtctcacaagatgtgatggttttataaatcgaagttccccttcacaagctctcttgcctgctgccatgtaagatgtgactttgctcctatttgccttccaccatggttgtgaggtttccccagccacataaaactgaatcaagtaaaccttttttctttataaattacccagtatggggtatgtctgtattagtagcgtgggaacaaactaatacagtaaattggtaccaagagtgaggtgttggtgtaaagatacctgaaaatgtgggagcaactttggaactgggtaataggcagaggttggaacagtttgtagggctcagaagaagacaggaaaatacgggaaagtctggaacttcctagagacttgttgaatggttttgaccaaaatgctgatagtgatatggacaataaagtccaagctgagtggtctcagatggtgatgagaaacttattgggaactggagcaaaaatggcttttgttgtactttagcaaagagattggtagcattttgcccctgccctagacatttgtggaaatttgaacttgagagaggtgatttaaggtatctggcagaagaaatttctaagcagcaaagcattcaagatgtgacttgggtgctgttaaaagcattcagttttatagattcacaaatatatggtttggaattggaacttatgtttaaaagggaagaagaacataaaatttgaaaaatttgcagcctgatgatacaatagaaaagaaaaacccattttctgggaagaaattcaaacttgctgtagaaatttgcatgagtagcaaggagctgaaggttaatcatcaagacaatgaggaaatgtctccagagcatgtcagaaagcttcatggcagcccttcccatcacaagaccagtggcagagctgtccaaggccataggaacccacctcttacatcagtgtgacctgaatgtgagacaaagaatcaaaagagatcatttttgagctttaagatttgactgttccactggatttcagacttgcatggggactgcaacaccttcattttggccaatttctcccatttggaatgggtgtatataccaactgcctgtacccccattctatctaggaagtaactaacttgcttttgattttacaggctcataggcagaagggacttgccttgtctcagatgagactttggactatggacttttgagttaatgctgaaatgagttaagactttgggggactgttgggtaggtatgattggtttttaaacgtgaggacatgagatttgggagggggcaggggcagaatgatatggtttggctgtgtcctcatccaaatattaccttgaattgtaataatccccacatgtcaaaagtggggccaggtggagataattaaattatggtggccattttctccatactgttcttgtggtagtgaataagtctcatgagagctgatggttttataaataggaattcccctgcagaaactctcttgcctgctaccatatgagacatgactttgctcctcattcaccttctgccatgattgtgaggctttcccagccatgtagaactgtgagtcaattaaacctctttcctttataaattagttagtctcaggtatgtctttattagcagtatgggaacagactaatacaagaatgaaattctgatattttcagaaaaaattaagtcttggagaaatttatcagcagcaaatatatgatacaaaatattaaagtaatttcttcaagttgaagggaattgaaggcaaattgaatgtcaaatataaaggaagaaatatcaagcacaagaaatgatatagtttgtgtttaaactataaaatactgtcactttcctctttaaaagcataagactaattgaatcaataactacattgtggtttaaagttagtagatagatataatgtatatggaaataagagcacaaggatgtgaggcaaatgggttataccatttcaaataccttatactttgagtaaagtaggcttctattaactctatatggtaggcttacagcatgtgatccttacagcatctatcaaaagaccaaacaaaagaaatccctaaaacaaaagattaaatttaaagccacagtaaaaaaaacctaataaaaaaagtatacaaaaatcaaagaaataacccaatttctaaatttttttaaattttttctcaaaaaaatctaaacatattaaagcagagtttcatacacttttcttggtcttctaatattatatgttctttatgacaattaaaataatagagcaaaagggttttgttttatcttttgaaagatattgttcattataaattaccattgtcttgaagtagttggagctctgtaaatatgttatgccaaagttgtcaatacaaagatttgtaagacaattattggaatacgatgtaacaatatatgatatataattgcaattgactccaaattaaatctcataagctatttttaatataaccctgagtaccaacacagaaatgtaagagtacccttttctcacctaacactaaagcatccagatttagtaccagagtactaacacaatttttgagtataaaaagtaggtaaaaatgttttttaaataaaagcaactaatgtaagttgtatttatatgctcaatagctatggttttataaatttgacagatattatgtttattttattgaaaaataatgcattatgtttccagacaaggtaaagttggctgtctcaatgattatttcatttaattctgtttctgctcattccttcctttctactttaacagatagaaatttttcactaggtaaacctaaatagaatgccaacttcctattgggaagaatttatagtcatttaaatttccaaatgacttctgcatttttccagtctttccccaaccaacattaaattcagtaaaatgcatttgaatgcatttgcaatatactatgtaaatgtaaatcaagaacatttcattgttcttatcatatttatgatattcttgccataacatacttccaatacagctataacttctagtaacctgtggtagcacttatagtctctattaccataaaccctaaagaagcatccacaaaaaaatacaagttatttctgctaagaaatggaaagcttcttttctaaataaccttggtgccagcctaagacagatactctataaaaccaaagtgagatgttttatcaattcactgttttcatcttaccatagttgctttataaatatgaaagagtatatctgctttatttctctcctctctctgtcttactcttgctcttctctcttcctataaatgtaagattatttgaaaaacacataacttcccaagagtgatgagtaagtttctattcaccttttattgtacagaaacattaatagactccagaggcagtgtcatcttcagaatgggtttgatctaagatggtgacaatgacaattttagagtttaccatagtggtcaaagtttcagaaagatttttttttgtctgttaagttgcaacaaatgttactaataatctgcacagtgataccagtatattattctaatattctaaacagctgttacgctttattaacctttgaacttctacaaatgttctaacgtaactaattaataaattgcaatgtaatggtaagtagagacgaaaataaaatctgcagcaaattattaaaatgcccattcattaaaaagaaccataacagaaaattaagaacatgcattatataaccatttcaaacttgacttcgaatgaaaatatttacctggccaaacaattttgaaaaataatcttaaattctgaagcccttgaagtacaattcaaagtgatgctctagagaaatatgaacaggccaaaagttgggtaagatgagtaagatttcagaggtcgctgagaagaaacataaaagctcagtctctggagatagacagcctggatttctccaagctctgctatttattagttgcatgatcttgggcaaattatttaatctctttatgcctcaattttcacataagtcaaattaggataaaagcagtacctccttcatatggttgttgtaagaattaaatgagttaacagtttttaagcacgtgaacaggagctggcacatagtaagtactgtgtaagtatttgttacatggtttttaaaaaaaaattaaatgcaacatttcatcaaatgcacaattatataaataattccatttgccctttgtagttttagaaaattggatctcaaactaaactagtaagttaattagcagctgtgagtaattaagatgctctttaagctctgaggaaaagtaggggaagagagatcaatagcagggagttggtagaggcagaattcagtgttctctcagacaataataaaaggaaaaacagcagtgtcttttcaaaagaaacacactaggaatttgtcaactccgcaagtcctattaaaagtaaatttaatgtcataattatacctttgaaaacagctgccattgagaaatcataacacatggccctctagatgaattttataccactagggaacttagtagctatttactgctgtaatcatttattcatccattgattcaaacatgcatttcactatcacctgaaaacacatgccctgaaaacacatggtacgtgaatcaccatccagtatccaaacatttcaatgaactgaacattttatcccttacagaaaatgatgttgggcaaatggattcaaacatttattataaacagacaactaaggtaggagtagggaagtaatattagaggtacaccctcttcaccagttaaataatatgaagagatagcccctcacagtggtcattttgggaaaaaagtgatttttaggcagatcttagtaaaatgagcatagctatatgcaccaattatacctgtctgcatatagaatttattttcctgtttgattggtggtacattaacatatagatgtggccatagcccattgttaagggggtattcataattttacttcattgccttaggtttagctcttatatatcactaaacagagattagcacaaggatcactaaataagtaaccaagagacccgaggagtaatccaagctctgccaaaaaccagcagtgtgacatcaggcatattacatcaaatgtaaaacagattgaattaaatatctccaggtgtttcaggattcaatatttttgatgaattagcaatgctattcctattgcctatggattcttgttagtgaagtaaaatataatttttattactgcttcaaaaagtacatggtatattattaacccgactgtgtgcttttgttatcagacaaataatataagtcctgaaacgtatagacgtaagttaaaagcttttacgttcagtcatgtgttgtttttaaagttgttttttttttcctgcatcttacattaaacgttatcctgagttttcaccatgatgttgtgttttagcaatgacttaaaatgatttcacaggtttttatcttaggagattatgtaacaatcttttgtcaacataaatttgtgaaagctatgtatagttttttgagccaattatctaccttaaatactaaaaagtttgctcctaccaagtattatgtcagaatctaaaataacgatgcaacatatcaaaatattcaaataatatatataatatttacatttctcatgaaagggatatatatatacacacgtatataataagctatggaaaactgtgttggaaattaaaaacatgaacactatctagctatttgaaaatgagatgacgtatctattctagatgttaatattcccatttatgtaacttcagtgttcaagatttttagtttctctgcctgatttctgtaaacagaaaaatccaatgtatcagctgtattgaccaatgtaaacttcccatacaaggaagatcagttatctattactaaaataatgctgcatagaaaaccacccaaacataatgactttaaaaaagtaatttattatatttttggagacaataggagagaagagtagttgtgatgatttgggtcatttttgatagaactcagctgggcttgttcatgcattttaggttggttggcacttggatatggctggctgctctagaatggtctcagctgggacaactgggccctcttccatgtattcctcatattcctatagcactcttgccatattctcatccttgtggcagggacccaagaggaagcaagccaagtcatgcagtagggatcaagagaacacatacacatacttcttaagcctctgctgtgtcatgcttgctgataatatgtggttggccaaaacaagtcatgttcatgagcccatagaataaaagggcactgcagagttacagtcagggaggccattaattggcatcattaatgccaaactgtaaaaaaaatcctgaaagttcattttgaattatatgaattttcagagttacatgtgctttgacaagcttaattattttaaattagtatccaatgcaagaggataaagtcattatagtcactttatattttctcatattaataattacttatttttaaaaaattaagaatgtaaatttttttaaataaatccacattcacaatgttgcaaaccttaaaatattttagaaatttctttaattatgtatgggtgtgtgattacattttataaacaaaattggaaatacattttatataaagatcatggttatgctgcatttatatgtatataattcatatatatacatatttaatgttatatgttatataaatatgtgtgaacatacacacacaagcatatatatataaatgcatatgtatctattgtctttttacagacattttcccatatagttaaaaattattgaaacccttctttaattcaatacattaattcaaatggattattggatcaaaactataaatgctgataaagcccttaacatttgatctcatactgccctttaaaatgctttacaatttactcttccatcaccagtgtcagaaaatacagacccttcactcccaaaaaaaacatggtaattaaattcgccaaaacaaaagtcaatttttttctttttttattgccatggaatacaattgttactagttgtatatcttttgtcaaatcattctgcctttctctgcttcagttaactcatctttaaagtttgtgtgactctaattcctagaaagttttagtgaggattaagtgcagtgagatttgtaaaatgctgagtgtgttgtcaggctcaaagcaaatgctcaaaaagtgtttgatatttttatttaatatcattaataatacatttatttgttttatctctcatgagttagatattcaagtattttaaatatctttctgttatgatgtttctaattttcttctcaacataatagagatttttatgataagcttataatttctttgtcatatgtataacaatgattcttcctgttcaacatttaccttcttcacagtattattatacatagaatttttaaatatttgtccaaatatgctattcttttaatgtatatacttttaaaattcttatacttagaaaggactgtttcaaagattaaatacatatacattaatatttttatcatcatatattaactttttccatcaaacttttaaattcatttagctagatttttgtgtactataggcatatcatttatatattaaatctcatagagctattgaatgacttactgaattgttccttgtaatgagtttaatacaactggtaaaaaagttctcagtgtatgttagctataaatcagcatatgttaactagatcaaggctttacacattgcaaatgtttcttttataacatgcaaaattagctcctaccaagattttagagaagcgctactctagacaatacagaaaacaaatagcagggattggcagtgaataagaggataaagcctataaaactaacattcaaatatgggctactaaaagtccttaacatgtggactcatcttttaaaacagttgatccatgtgtgaaatactagagaaaaagactacataagagaaccatggagtttacttctggaaaaacaaacaaaacaaaatacaaaaaacaaacaaacaaacaaacaaaacagtggcaagcagttattcccatactgagaaaaatttcctagtatacacctgacttaaatgttgcctcaggttatcagagcttgccatactttcatgtaaaacgttcatgggcacattcctctagtaccaagtagtgcagatataaaaatataggactttataagaaaaaagtccaagcaaagctcacctaatcttccaaattctcattatcctctgtttaggctgagcacagatggtctataaaaagtcatggccaagtttcagtacctaggctttccatacacataatgcagtatatatttttagtgttgggagcagagactatccatgtaaccatgtaagaatggaaattgcctagtcagagaattggccttgttaaaactgggaagactcaggagctcagtattttaaactaacctatttgtttgttgaactaacttagacctgctgaaccagctctctgtgaagccacagaaaaaggagagagaaccttccaggccatccatctggacatgctgattgaatacatgcattgttacccatatctttggcttccacaaaagtcaatcttatcctcagccaagaatgtttggtatccataaaacctcccaaaactgcacgattgaaacagtaccatagacagaagataaagaccttgatcttcacataaaatatgtattaaagctataatgctattcaatatattatccaagtgtaataactggctggcccttgaaggccagtggttgttggcacattctgtagactgtagaggattagacagtattgacccttgtgacttgtgagtatgctatcactgctgcaattagcatttagtttgggggaggggtatttccaatgctttattttttataaccctcctgaaaaaaggaagcaaaaagaagattccctgtatttggtttagcatgccaacaattgtcatcagtgggttgtgcaaaccctagtaccacataaactactggtagaagtaaggatattctattgaagataaactgctgaaccttcagaaccaactacggataaactggcccaagaccaattagcctctttgaaaactgaagatagcatattgtacatctgggaatgcactacaaacattatatcaaataaacagacacatgtccaaatcgaatgaaatcttgagaccaagaacctttaaatacagtccagacaacgtaaattaagctctttttttgcagtatattaacttgttttagtctctgtggaattgcagatattattagttgccaaccccacagttgactagaacttttgccactaagacccaactggtatttgtccagcctttgtgtctgtggaatccaggccttcctaactttgctaagtagttactaactgggatgttagatgatttcaatggagacctggtgcctcctttaaaaaaaaaaatcataattttttcaacctaactatcttatcctgaaattaggcttctcttgtttaaaatcgcatagtctaggacaaatccctaaagtttctactttgtaaagaaaaagctgcctttaactgtgagataaatctaatccctaaggccttagccacttttgtaaacatgtagctaaacacccctccggagcagagacagtcttgccacgaccacctccgaggcagacaaaacaatggcgtgctgcagccatccgtcataataattgctgagagcaaacactgaattctttagtcggctgaatatcacctgttcttcttatctttggaacacatgacccaagacagattgacaagtagcttaactgcacaaaaaggccaatggatctacaggcattgaattaccaagacacacccacatgaggtttctccctatgaaaacagataaacagcctattcatatgccgaatctccgctgcaacctctgcctcctgggttcaagtgattcaccttcctcagcctcccaagtagctgggattacaggtgaccaccacacctggtttacaggtgaccaccacacctggctatttttttttttttttttttagtagagacaggatttcaccatattggccagactggttttgaactcctgacctcaagtgatccattcgcctcggctcccaaagtgctaggattacaggcttgagccaccacgctgggccgtacattctcttataacttgagcacacttaaagaaaaatatttggattgacaaagctaaatcaaatatttgtgaccattatctctatagcccactggattaataataaaaccaactatattaagggactctaatgcccagtggaaaattatttttacgtgtgtgggagccatgttatcccacagactgcactttttgacaaccatacaagcttctctagcaatgaccttcatcggaaccccaattttaacagtatttatttttgtactggatatgaccctgccttcttgccttggatgaactttcaggtaactgaaagtctctctgtctctctttctctctctttctttccaccacccccacctgaccttcattgcattgacctgagcatatggattgtcattcatataaccttatggaatattgggtagctcacattgctcagatcaggaagtcctggaaaaatacgagtttggacactgacttttcttctgatggtgctagaggcccttcttctgcacccagaagttgtttatgatgatgaatttgagactcccggctccctgtgaggctctacactctagaaaaaaaaattaatggaaaagcaaggcctggcttatccttgagagggatatcctccactagggaggataacagacttcaacaggttaaacataaacatgacagaccatgagggagggtgagattgaaggagcaaataagtcccactttccctatttcacaggtgtggaggagctaccaaaaacagcctcccacaactgtttcaacattgattcataatgttaactctagcattttgaggatcttattgatgtttaactctcagaaagtctgcacagccttctctattaggacacaaaaaccattttacaacctgatgatcaattaaatcagatgtttatatacacagagttctcaaaagctatagggtgaactgagtaatgctatagttggagatccatatcctttttcttttagtagctgagcaggtctgaatttgcttaacaaaaaaagaagttagtgccagtaactatgttgccaagacactcctctttttaagaaagttgcaccactaaccaaggtgcttccacagctacatacactgaaaatatatcctgccttctgttcattaaatatgtagagcatcactttgactggaactctttattggaaaataggtcatgctgtatacagaccatcggtgctcctcttaagttttaggacataaagggtcacttttagtaaggtcctttgtaagtatttgcatgtcttgaataaatgtcaaatgtgtctcttctgaggaagatactatcagtgtgatgtcacatctatacctctgtaaagagttgagtcagaataagattttgcctgaaaagttcgtgtgtgatggtatggcagttagggtgtctaaaaaaggtgtattgtgctctttgaacgtaaaggcaaaactgcagctaagaggttgttaaaataggcactggtcatagcatgttagccaactctataatctcaaaatattagtcaggggatgattgcatgaagacattcatttaaaaacactgtgtgtataggcctgaatgattgaaataatagcattaaggtgtgataaaccacagtaaagcacccttcattctttcccagtttaagaacaggctaaagcagtggagattatcactgcttctattaaataggtcttgtatatagatttcagtctttgaagacccgttttaaattatatatgactgcattaactcataaaaactcctattttaactgtggaggcagaagaaaataatgtctattggtcactttttaaaaaaaaaatccattatataaacatcaaagatataattttgttttaacgtattattcattggatcagaaggttcctgcccatttttttaaggtaatgggtgctatgaccatgggaaaatttaaacaaggaaattgtttgcatggttaaattgaggcagaccattttatcctctattttggttcactaaatctcttaatactatggaagttactttggttacattttgtgagatccccagacataacagtgactggagcttcagttttaaataaggcaatgaaagtttgcaatttggtaaacgttaacagatttaaaattaattcagaacctgggttgtagaggaggaaaaaaccaatgagcactctttcatccttttttaaagttttattgagatactgacatataaagacctgcatacatttaatgtatacaatttgatgaatttgaacatataaacaaacccatgaaatcataaccacaatcaaggtaataaaaatattcatagcttccaaaagtttccttgtgccacacttttttttttgtaagaacacaacatgagatttatcctgaagctaggagacattatacagtgaaataagccagtcacagaaggattattactgcatgactccacttatttgaggtgtctaaaatagtcaaacccacagaaacacaaagtaaggggttgagggagggggaaatgaggagttgttcagtgagtacagtataaagtttcagttaaatgaaatggcaagatctagaggtctgctataccacatagtgtctattttaccaatattctgttgtgccccattttctttttgctacataaattattttagcaaattttggataatctattgggtaaaattatggatttctgctaaggtagttttttaacctgaattttcatattcagttttctttacttttttctttttatttttggcatttactaaatagactttggggattcttctccaccttcctcatatttacagggttttttttttttttcttccagaaaaactcaactaagtattatcagggcttaggacaaccctatgacaatggtcgacttgctcaccagcagtcacaaggtaaaggtgagacttattttcttgaacccagcctcagtcatggtttatccatgaaccagcagacctggttcaatctaagacacagataggtcttgggcaagacacacaatgctagaccgctttaaggaggaccaaaactctatacaactgttgctaaatgccaatttttgaactttcaacttatttcagttaaaacagaatctagacaaaacttagaaaatgcagaataaagcagcacagcccaaaagacaagatagctatcaagcggtagctcagaaagcatgtttgccatcaggcagcagaccatttaacaagacaaacaaataagaaagactttttgtaaatagtggtggtcattgtctatacatcttgcttgtagcaacaattattgtgaacatttctcaaatatagaattcactgccacccaaaatttggtttggatgttgagactgatgatgccatacacataacaatagattataaaaaggttcattactcacatgatgaggctttctagggagagaaggtaggctcccaagcaggccaaaaaatggcttgagagagagggataaggaaaatgcattgaggtttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccgcattgaggtttttatggtggttagacgatggggcaggaatgagtatttcccaaaagcaaggatttcgttgtatgaaattctccctgatgtcaaagagaaaacatctgcattttcttatcagtgtacccagatgtggggcagaaggggaagaaggtggggtgaagcctaaatactgtcagcagtaaaacatcccaaaatggcattatacactttatgaattcacctattcaattctctttcccgctcccttccacctggcaatcaatgaaaaatttactgtctgtagagttttgcctcttccaaaacggcatattgttaaaacgttacagtacgtagacttttcagataggcttccttcacttagtaacatatagttaagtttcctccatgtcttttcatgggctgagagctcatttttttttttattactgaatagtacacttgtatgaatgcactacactttatttattcattcacctattgaataatatcttggttgcttccaatttggggatattataaataaaactactataaacatatgtttgcaagtttttttgtggacataaacttgcaattcagttgggtaaaatctaagagcataatactgcatcattatggtaagattatgtctacttttttaagaaactgacaaactgtcttcaacagtggctgtaggattctacattcacgggaacaatgaatgagagtaagtaaacagagtatgttctcatcatttacatttctatcttggtcacatagaaaatttgactatttgttcccaatatctatatttgtatatatgtcctaatagtatttaaatgtgcattgttttaaaatctgagtttttataggcatctaaataagccttcctctttgggagaagacaagtattcatcaaggatccttatcaacactgaggggtgcagagacttcacatcattatcataacaatacaacctgaaaagtaggtgtggtaataaaataggaacttattgaggtttaatgtgttatttaaggccctgtagctaataaatggcattcaaacttaagggtatacatcttcagagtggatacttttttcacctcatcctatatcctttctgtactaattaagagtcactttctcatggatttggaaaagtgttaaagtgaaagaaataaattgtaaggatattataactacacacctaggtagagttgaaataggcctttaccatatttataacttgacaaccacacttgcagcaagtttctcttcttgggatttttctgagctacctgggaaaactttccctccttcactctttatttcaccccacttgaccaataacaggggaatgtccctgtatgatacccccattgcctaagcagctattcagcctttactttggagaaaaagtttgttgcaaatgatgtaaaaacttctgctacttttccacaaaaagaaaaatgtcatcaatgagtaatttaagaggcttcacatgaaaacacaaactaatgttcatgaaataaatgcagtcaacagaatatattgtttgtcctttagcttatcttaaaggtttgagctgacgtaaagaaatcagtagatttcatataggaatacagatatgtagaaaagtaaatcagtcaaaatatcttacatgtaaaacacagattacacattcacagatactctgcatattgctgtatctatttgtattcatattaattagtttatggtggcattaagataaagaaatttagccaaagtctctttatgtttcagtatgctgtaggaaatagccaaatattagaatcactttattttaacagtgatatttcacactgaatgctccagtgccttttaatcattgtctaccaatattcaaaataggtaccaatgcatgaaaacagtttctcaattatgttcttaatgctcgtacttaaacaggctaatttagttcagaagcatgtctatttcacttttgaacatttattttatattgtgtgtaccttcagggtttatgatcacaaaagcaaaccaaatcctgtatactgataatttgtgtgtttttatatagtcatgtctgttagttgaaaacctagaaaataacttttgattattgaatcattgtcacaaactaaagaagttcataccaaaaatcaatggacttcaaacttttatctttaatccataaaatttcttaagctacaacagtaaaatatgcctactcatttgcttatttttcaaatttttttaccctatactttgaatgctatgctaaagtattttttacgttattaaagataatcaaaaatagaaattaaggtggatgagataaaagtaatagaacttttaaatattttctattatataagttgcttgttttccaatcataaaaattttattgaattttaaagctttggattaagatgtgatttattatactccacatatcattctgtacatatattccaatttatctccaaatgtatgtggattttataaataaataatgaaaatatgattaaatatactttactattttttaaagtttgggtataaaactttacacttcagaggtttgtttggataattctatttgatgactaccatacttgaaaaacatatttcaaagataatatatccaaatgaaagtacatgattagctgttcttcctgaattgcgatgatcacattccaaatcaatccacccattatgccaaggctttggttaaagttcagcttgtaaatttttattctccctaatgccattcaattattcttttaaactaattaaaatacaatgcttttttgtttttacatttagagtacaccattctttggaagatttttaaataaatggaaaatcttttgttgataattgttaaatatgtgaatatcagagagccattataagtgacacaaatatcattgtagaaaacaaagtgaaatagcaaaaaaaaagtctaagcaactctattcgaagttctctctcttcataaaatgtattttttccttaaaaatcttgttattacgttattcatattttgaaatactatctaaatcttatgaagataaaacattttaaaaacatttattgagtagcacagtataaattttcagtacttttatcctataattttgccaatgatacagtcatgaaaatttcaagattgtcaggctttgctatttttcgtgcttatcttcaaagatggttttattggaaaagttctataaatcttttgccgattttataaattagattaattacatgttatatctgtaaattctcagaaacataacaagtctaaaattttgaaagccaatgaataaacgcctcgacaatgtgaaaatttttcccttttatgcttaccgtaagtgatatatcatattctattgataggatatgagagggtaccaatataaatctatgagcaaaatgttagtaaatcttaatatcctcatgttattaaatgtatgtgtgtgtgtgtgtgtgagagagagagattttgttttggtatcacaatgtatagtttcctgctctaccttggggatacaagaatctaattcgtagtttactgctctaggctactgaataaaggtaccacttcaaaatcccaaacctagaacatatttctgagctcttaataaaaataacataattgtaaaacccctcaagaataatgagtttgcctcactgttatatctcccatcatgcctaataatgtgcattccacatagagaatattctattaaatactgattgaaaatttaatctaaaaaggctaaggtatactcccaaaccatagattttgagtttcttgtatgcagaactcatacaatacaaatcgtccaagataatttttttgctttattactatttgctgatggaagcattactatatttttagtataaatctacttttcccaagagcaattccttcagcagctgacttagtagatatttaaataattcaaaatggatctgcttcctcaaaagagaaaaaaaataagtatagcataaaaaaactaatcttcaaattttgatatggctctccactgcatcacaatcatcttgacctagcgaagcaaggtgtggtgatacagaccaatgattaacacatttgacaatcttttccaggacatttttaatcacactaaagtttatcaagcaccatttcacatgatttccaatcatagctaactatattatcaagtttgtacttggcagagccaaaaaggaacttaactcaagcattctaacttcaaggtagcattcctgcatcccaataattttgttttctcttacatagaaaatttctgctatctcaacttccctaacctggaccactccctttaaattaagcagtccacaaattgcagctaatatagtacattgaattaagaatatttttaagtgattcaatgtgaaaaaattaagcctcatctaaaaatgtgtcttattttccttggataaacattctcaaaatagtctcatattgtgtaccagacttttgctatacagttgtagtttattctgtgtgtcaaataaatttttcctaatgatttaacattctgttccaggagcctagtagaatttgccttagttcttgacaaaatgacaatgcccagtgaagttctaggcttcctctgataaatagtctttctctgaagatagcaaagaatgctggaatcagatataagacagtgaaagcaacaataacggagctgtcctctatctgtctattccaaacatacaatgcaatgcctatatcaacttacagattaccgttactcttggtcgctcacctctgtcagctatcaacaaaactgattctacttgaccctacattccttaatgtcctctgcacatccaagttctttgttcccctggaatgtaaactttcctttaaattattctgttgccttatgccatattatattgtattatattgcattgtactatattattattggtgcttccaaattaccaaaatgataatagactcagaaaaattaatttttgttaatgttcctggaaggaggacaggccagaacagttcctgacaattgataattgattaatttatgataaaatatataaataaataagagaactggcctctaatatttctttactgcttctctgataaaagataggcattttaaacataatgatttgaatgtttagtgtctgccttggtaatttgccctgtaaaaatatgacatcctctctataatggtattctttatactgggagcacagagaactcaacattttcggcaatcttttttcagtggtatgtaattttatattcaatgtcctttaagagtctaaaccaaagaagtgccttctaaaatatgctgaagacaaacaagtgtgttatttatgtgggaaactatgaccaggcaatcaattttgatcaagtttttagtctatacttgagagaaacattaactagagaaagaaatcttagtagatgaataaggattcactttatctccacatataaatattttggtacaatagcacatgtgtctctatatcaattaattaatagagagatagatacggatatataaatatataaaatagaattctcaactagaaactaaattcagaaatgctcactatattcatctattttaagcaaaaagaaaaataaagtttccttattaattacatgctcatttataaagtagttctatttaatgaacaaagtattcttttatactttacctatgtagactcaaacagatttaagctttttataagaaatgtttctttaaacaaagaagacacatttagttcactggaaagttcataggcatttcaaatactttggaatcttagtgaatactttcaaacttctatagattttaatttatacaaaattgaagaatttttaaataatgaagcactttttttacttagtaggttgcatctattaaattttgagcagagtttctttattgagtctaattgtagtcaacctacatcagatagcaatcagaactgtcaggtatcttttatttttctaggaattgaggaagatagaaatgatatatgaggttgaagagatcaggcataatctttgtgccctgaaacctctacccaattgaacagttacaatgtgcttttgcccattttatcttaggcagtaatccaaacccagatttgaaaaagtcagtcttgtcaccaacaatttcttccatacatgactttaaacttctaaattgacccagttatacttaattcaatcattctggcccttcacatctccatatacacttatgcagggtataataatattttcttaaatgtcattctgtgtatagatataacttacatgatcttgctaaatgattaagtgctgacagggtttataaaacaagaacatacttttaacatagaatctttttacaactgttaagatattaaaatgtagagcaagttcaaaatctaactactaatgtttaaaaggaaagtttgatacagtatgccactttttctcctgtgtaaacatttctgttaattacatggagtttaaaaaagctttactccatcctggcagttccctagagctaacaattgttgctgagcttagtgattgtggcagaatgccaattacattgtatgatgtgtgaaatatctgctacaactgtcacaatgcaacaaaggtcacagaaaacatttaaaagccaaaggcttagaattagttttctcattgaatatgtaaataacattttatgtctcaaacttatttatataacaataagaaaatatgttctcatattaaataccaccacaaattatcatattccattactccatcttcactactattttatggtcaattaacaaaagaatagagaacacactagacagagaagttgctagtattatttttatttacagaatttgtaaaatgagtatagctttcccgtgttcttggaaatgcatatattagtgtacatataagtagttatatgtattgtacattgtacaagagatttagctaaagagtatttggtgataaacatggcttaagtaggtttaaggaaggaagagagaaatttcagagataattggaagatgtgtaatgtcatatggcaatatgaatgaatctcagcaacataataccaagtgaaaacaaaatccctagacaaatgtctatgttataatactatttaagtttaaaacaaataataaaatattatggatatgtgttatgaatatatatcgtggatgaaaaaaatttaaaaaggaaattatttttaaactaagattagcaatttcttttggagctaaggtggaggaagaaagtaatggaattgagaggcatgtacagaagacaattttattgataaagtattgtggagagttaaataacttgttttatgcagaaagtaaaagaagggtccctggagaacctctgatgcaccccacaagtcttacaccagatatttttttttttttttgggggatggagtctcaccctgtcgcccaggctggagttctgtggtgtgatctaggctcactgtagtctccctctcccgggttcaagcaattctctggcctcagcttcccaagtacgtggaactacaggcacgtgccaccatgcctggctaattttttgtatttttaatagagacagggtttcaccatgttagccagtatggtctcgatctcctgacctcatgatccactggcctcctcctcccaaagttctgggattacagatgtgagccaccatgcctagcctataccagatgctttatgcagctaagggaacttgcacaagaggcttgcctaaacaggcctacagtggaaaatttcattccttagcacatgagcagtaagggaaataaataaatatggacaggctcagactaagagcccgcatgtgcactggaaggatggggtggagctgccaggaatttgcaccttgttacaaacaacgaacccagcctcatcagcttataaaaaaaattccctgtattcaaccgtgaagggggtaactggcaacctgctttcaggaccactctctctgctgagagctttccttttgcttaaaaaattctactccactcactccagtgtccatgtgcctaattcttccgggtcatgagacaaaaacttggacccagctgagctaaggagtagaaagatcacaatatattttatttcttatattaagtaatgtatatgcatgcatgttgcatcttcaataggcaatatatttgttgtttatttgaaatattacctttctcaaatttttaagtatatataattgacaaaacaccaatagaaatctatctccagggttcagtacagacataagctctgctttagtctggtggtggagtggactacaatattcagaaacctgtaatactcaggagattcaccatcttctttgttgacagtcattagaatgttgtgagcagtctgaagtttgacagacatgttgatcaacatctgtagctccacaaacatcagagaaaagcttttgaaatacttctgctgctgcttccacaagttctccctctgttagacatattcatagtcagaggaaatcaggaatgtgtaactcttgtcgttgaggttatgtgccctgaggagcgactcctgcttggagatattcttctttagactctcaatggccttgctgccattgtctatgttcaagagagagagggaaagcaagatgtatttgaaaaggttataaataggtagatatttaaaaagaggttattaaaacgtacatatgcataatttaatttataactgcagtcatatgttgcttaatgatatgggggataagttctttcttttctttcctttttttttttttttttgagactgagtctgattcttgttgcccaggctggagtgcaatggtgtggtgcaatcttggctcactgcaacctccgcttcctgggttcaagcaattctcatgcctcagcctcccaagtagccgggattacagacacccaccaccacacctggctaatttttgtatttttagtagagacggggtgtcaccatgttggtcatgctggtctcgaactcctgacctccagtgatccgtctgcctttgcctcccaaagtgctgggattacaggcatgagccaatgcgcccagccatgatggaggataaattctaagaaatgtgtcagttaattctgttcttgtgtaaatatcatagagtgtacttacacaaacctagatgtgatagcccacgacacacctaggctatctgttctagcctattgctttgaggctacaaacctgtaccatatgttactttactaaatactgtaggcaattgtaatgcaatggtatgtatttgtgaatctaaacatacaaaaggtacagcaaaaatacaatataaaagataataaatggtgtacctatataaggcatttatcatgaatgaagctttccagtttgacagttgctctccatgattcagtgagtgagtggtgagttaatgtgaaggcttaggacattattgtacattaccatagactttataagcactgtacatttaggctacaataaatttataagaatttttttcaataagttaaccttaacttactgtaatttctctattttataaatttttatttttttctaactttttgactctgtaataacatgtagctgaaaaggcagacacattgtacagctgtacaaaaatatttttcttctttatatcattattctataaggctgttttatatttaattatatttttccttttaaagctttttgttaaaaattaacacacagacacacacattagcctaggcctacacaagctcaggttcatcagtgtctctgtctcctactttcacatcttgtcctactggaaggtctttaagggcggtaacatgcgtggagctgtcacctcttatgataacaatgccttcttccggaagacctcctgaaggacttgcctgaggctgtttttttcataaatagaagaattccattctaaaataatgataaaaagtatagtataataaatacataaatcagtaacagtcatttattattattatcaagtattcggtactgtgcataattatatgggcttatatttctatatgattggtatccaaatatgtttgtttacaccagcatcatcacgaatacatcgtgacgcattttttaggacattattgtggttacaatgtcactaggtgataggaatttttcagctccattaaaattttatgagactactttcatatatgtggtctgtcattgaccaaaatgttgttatgcagtgcatgactgtatcagaattattacaagcattcaaaattaattaatatccaggagaagaaaaagttaaagaaataagccagataaaaatttatatatagattaagagtagctaaggtttatcaactctcaaatgttttcacttaatagtcataattaaatttgtggtagttattttaatttccatgttttagatgcataatttgaattcagagaaattaagcaatgttctcctgttctgcccttctgcatgtctctatgattatctactgcacaggtgtgatggatctagcggagtgactgtgggcacattgattcctggatatggaaacagtttaactttaatcttgagtaaatgaatgaggagaaatggagaaaagacttttggttttccagtaagattttggtgacttatttttaaggaatgatttttatataaaattggggctaaagttggacctgagaaaagtaaggtaacaggtaaaaatcacgagtttattttcttctccttaaatttagccttgtgttttgcatgttttctgtttcaaacaatcttgagcagagataaactaacaattttttgtattctatctctccacagaatggctaacttgtttaactttggaaaaactgaaatgactaattagaatgtttccaatctatgtgatatatatttgaaagagctacatgccattggatgtttttgtagctgctaacaaaaaagggttccctcacagatgaatgaacggacttcttcatggagactgtttagacactactttagaaaaggcattttttttggtgttgctactaggaaattgtgtgtgtgtgtgtgtgtgtgtgtgtgtgtgtgtgtgtgtgtgttttcagtgtctctagcagctgaaagtatgcaagagctaaaatgcagctacagctggagctaactcccattcattcatcattgtcacttcacgaattaggagccagcagaccatttctctcactttacttcagctccttttcagaacgaggtaaggttcataatgctcagatacgatagttctttcttctagcctattatttagagagctattaattttgttctgtgtcactctacaaactcttgagcttttcaaaaggaaactaaattctgactggtgttcatatataaatatgtgcatgtatgtgaacagcacgtatagtgatagcatttgcttaacattttaatatcatcatatggttgtggcatttttacggggtatgttctaaattctctcaaactttcaaacagcttgccttttctctcagtcaaataatcatcatctatgtaaagttcctttttgcgtgtgaaaagcttcacactttccacattccaaagcttttattaagacattgatagtagtggattgaatgattatgtatgtctactgaattgccaataggataattagtcacagcatcatagaagggaagttttctcttaaaataaattgtattagatcaatttattctctttcaagagttacaagcattaacctttggaatgaccattaccctttaattggcactcttatactgtctaatgtatcattagcctttgtacgttgtgtcattaaaggtggcaatcataatattcagtaaattataacactgtaacaagttgggatcatctttttagctccccaaaagccactaattaattatgggaatatgtcaaaagataaaacgaagctttgttgcaagccaatatttttcatctgtttaacctatcacaaatagagttatagacccatgcaattgataaagacacaaaacataattataacttaactttgacaagatttctaaagaactttgtgtaacaaaaccatgacagaaatggtctcttatgaaatatacatcatgacttgcaaatctttggaatttttaaatacaaaatccatgataaggatataaaattaaatagagaggtttcctagagtagtcaacacataaaaaaatcaacttttccaatgtgaacagagtaaaatcaatgtggccaaattgttccattaaaatgtatagtgatacatagatacatacactagcattttaaatttgaaaaatagatcattataaccctagtgtactgatggttataatacaaaattcatttgtaaacgctttaacacgaagaagtgcagaacttaatattattttgcaggtaaatttttacacacagttaaacagagggattcacatgcctagtgtagaatttgatgtctatataatatatacaatttggtttaaacatttatagtgtttaatataaatatttaaaaacaattcttatatagtattttaaaaatgtaataactttgtcttaatatcatgttttgctctctgacctaagttatacactcagaacaaatgcaacattttctgaaataagtttgctatgggtttcattctattgacattgaaggaaacctagtaaagcaactcattctgaaatgccttcctcctctactcactcttgtagaaattatatatatatatatatatatatatatatatatatatatatatatatatatgtgtggtgtgtgtatatatatatatatatatatatatgttttttttttttttgagacagagtctcgctctgttgcccaggctggagtgcagtggcatgatctcagcttactgcaagctctgcctcccaggttcacaccattctcctgcctcagtctctcgagtagctgggactacaggcgcctgccaccatgcctggcccggctaatttttgtgtttttagtagagatggggtttcactgtgttagccaggatggtctcgatctcctgatctcatgatccacccacctcagcctcccaaagtgctgggattacaggcgtgagccactgcgcccggccgaaattatgtatttttacacaaaggaaaaaccttaagtcatcactactgatttcaatctgtgattaactttgcagtctttgcagacttctctaatactcagaaaaagaacagattcttctttcctatcagagtttttcaaaataaaataactctcttggacctggctttctcaaattagtggataaactgaaaataattccatcaaagattattgttgttttatttagtagtacacataattgataaaaatactgtgacaccaaattctaataagaaacattttatggaatctagtttatttagtagataaaatatatcttccgaagacattatatcgaaaaaaatgtatagacaaagctccgtgaaaagttacttaactattagggactaaagcattcaggattttttttttttttactccaaattgcaaatgcattaacatgtttgtgataaaatatatccacatttaaaattgcagagtcttttagaacagaagtattttagagatatctgtagcctcctactactgtaaacatgaggaaactgacaccaaaagatcttcaagcctcttccaattttatgtagataggctattgtagaaaaagcagtaagtctcagtcatctggtatttggactattgctctttttgcctatttgtcctgtctctctacttacacattcgaaccttcttgtctccttttcatcaaggattatctgttaaatgcatgcttatcactcagtaaatactgataatcactttattagttccatttatttgtgcaagaagccactattggctctactacataaagagctaaatgagatgatacaaagtaaatgaacatgagtgggatatggaaggaattgaattttgtaaacaaaaaaatgaggctttttagagatagctgtacttcaaaataaaatatgtaagatcataatagaagacaaacaaaatttagaaacattcaaaggaataaagtaatatgtctacatgacctatcatcaaaattttaatcaggaatcaggtcactaacattgagctttggatattcatagaattcagaatgaacagaaaaagatatagatagatatagatatagatatagatatagatatagatatagatatagatatagatatagatatagagagagtctcgatctgtcaccaagtctggagtgcaatgttgtaatcttggctcactgcaacctccgcctctcaggttcaagtgattctcttgcctcagcctcctgagtagctgggattacagacaaacaccatcatgcctggctaattttctgtatttttagtggagatggggtttccccatgttggccaagctggtcttgaactcctgaccttgtgatctgcccacctcggcctcccaaagtgctaggattacaggttcaagccaccgtgctcagcataataatttttaaaaacaaaattgttattttaataaagaaaagcaagcttttcagcaccaagaaaagttttaagcacatgctgatttatttatagtatttaactcattgatcaaaatataaaaaatctatacattatttactttaaaaggggaactattcatacgtattgtctgatccttctcagaactatggcaaaagcgtacaattaaattgtatttattctagttatctgacactggatacaatacaatgtaatctctgctctaaagttacttatgccactttggaaagcttacaatttatacacacacacacacatatgggtgggtgatggtgagtgtgtgcacgggcataagtgtgtgtatgcatgttagtatgtgtgtgtgtaacacattacacatacacaaatattaaaatttattttgatctccattttttaaagaacatctctaactcatgtctgagctgcagaggtttgatgaagaaccacattgttcttgtcatctacaaaagagaaagcaatttagatactcttcaatttttttatggttaagtatttgtgctgagttttgtgtttgctgagaggatgatgccatgagaacacagagtacatgcagcagtaaactggttgaaaaagatctcacttccatcttgggaaaataaattgcaccagtaaccagcaatatgcaacaaaagtgtgaaaatagcatattgtattctactaacttagaacttttaccaaataataattagaaattttatcaaataataattgtagataagaaaaataaattctatgttaaaatattagcattttttttacaattggtattttagaaaacaatctaaatggataatatagaacaaaattaaaatactataggggttctttctaaagaatattttttaaatgaccatataaaatttttgttcaattggagacaattttaatgaggataatttcaagagagcctatgcaacaggtataaaccggaactgacaggcaaactaaaacataaggtcaccttaaatattatgcacctttaaatatgaggctaaaataatttattggctggaagtatttgtattataaaattaacttcaaaattactaggtctagaataatcacaaatatataaattaaaactgatttgcttggttggagtagatatatctttatggtaagacattcattttacatttttatagagaatatatattgtttttataatatagtacacattgtaaacattgtagccttatttcaaatctggcaagaattgccgtagtagaaaagtagtgtgacttgttcaaaattctcatagagataaactcaatagatcagctgtacgggaaagagaaattgtagatagaatgtatgtgctatttttcccagttcatttccaaatatttaacagcttagaacattataccactaactttaagtcacattccagggaatccattatagaaagctgacatttgttctgcaagtgacctacaaagtagatagaatggccagttgtggtggctcacatctgtaatccaagcattctggaaggctgaggcgggcaggtgacttgaggccaggagttggaggccagcttgggcaatgtggtgaaaccccgtctctactaaaaatacaaaaattagccgggcgtggtggtgggcacctgtagtctcagctactcaggaagctgaggcatgagaattgcttgaaccctggaggccaaggttgcagtgagccaagatcgcaccagtgcattctagcctgggcaacagagcaagactcggtctcaaaacaaaaacaaaaacaaaaaacaaaaattcaaagtagatagaatggattataatggtattctgagggattataagattccagagaatgtctggaaagtatattactttttagtccaatttgggaatatagtttcattattttaacatgctgttcaattaagtgtctgtcttttaatgataactcactagtaattacatattacaaatgatgagttgatttggggggggaagtcacattttcttagactacagcctatataagtaaatatggaggttttagctaattcaattatacacaatttttcctgccctgaagaaactcgccagtaaaagggaggatatagcaaatctctagaaatgagaagggaaatatgcttcctaattttaaatgtatgtagttataaatcttcatccatttagaattc

SEQ ID NO: 608 - DNA, 3898 bp, Homo sapiens
cgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaaaaaaaaaaaaaaa

SEQ ID NO: 609 - DNA, 4014 bp, Homo sapiens
tggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggaaaaaaaaaaaaaaaaaaaaaa

SEQ ID NO: 610 - DNA, 1104 bp, Homo sapiens
gggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacgcaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcat

SEQ ID NO: 611 - DNA, 527 bp, Homo sapiens
ttttaagagtcagtatttattctgattaatattttacaaaattttgacatttaatttatgtaaggagggctaatttattaaacactttacaggtttttctttccacagaataacacggtaagtagcaaaataatacttggcacagttataaataaagaaaatataaaataaaaacatccatagcttaagtacaatgatgctgttttacgcccattaatatcaaataaattcctggaaacaacaaaaatatgaatgaaaaaaactccaaggaagtaattcatgttcagtgctgagaattaagttcctatttgctaaaagtatccaattaagttgataagaactattcccaaaggttcaccatcatacacaactttagaactgggtttatagttggttccacacacaggacctacaaaataattaaacagatggtatactgctgcatagctggctcctgaccatctgaccatttctgagttatagatttcacaggtactacaagatggttactacaaaagcattcacat

SEQ ID NO: 612 - DNA, 601 bp, Homo sapiens
  misc_feature (492)..(492): n is a, c, g, or t
tttgagaccaagtttcataaagtttttacttggaaaaaaaagttttacaaaatatctttccaaagaaattttcccatagagtacaattaattcatgtagctttcttccttaaagattacagtatgacattcagaggggcgaggtttcttgaatagccaactagccgcaaaacctcaggtgttactgataagggcaaaagtttcttttgattttcttgtggttcctcttccaaaatgctctcactggtgtcactgcaagtggcttcttcgcagctgatactcctcaaaactccccgcctatcatcaaattcagcagcactgctttcactagtgtcgctacacacactattctctctacttcgagacttcaggatggatttgcgagggacatattctccattcacaacatcaacaaaggctctgtaaatgtctgcaggcgtcctgatggtcggcagctcctgggcagagtggccactgccagtgctgttctttncgttacgtttggcttcttctttcttttcactgaattttaaaggggtattctttccagtatttattcggaccctcttaggcttcaacagatgtgaaaaatatattggtgg

SEQ ID NO: 613 - DNA, 4041 bp, Homo sapiens
ggccacatgtcgcgcatgtcttcccgtcggacggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttcaaaaaaaaaaaaaa

SEQ ID NO: 614 - DNA, 1408 bp, Homo sapiens
ggcgctcctacctgcaagtggctagtgccaagtgctgggccgccgctcctgccgtgcatgttggggagccagtacatgcaggtgggctccacacggagaggggcgcagacccggtgacagggctttacctggtacatcggcatggcgcaaccaaagcaagagagggtggcgcgtgccagacaccaacggtcggaaaccgccagacaccaacggtcggaaaccgccaagacaccaacgctcggaaaccgccagacaccaacgctcggaaaccgccagacaccaaggctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagaactcgagtacagaacctgctaaggccatcaaacctattgatcggaagtcagtccatcagatttgctctgggccggtggtaccgagtctaaggccgaatgcggtgaaggagttagtagaaaacagtctggatgctggtgccactaatgttgatctaaagcttaaggactatggagtggatctcattgaagtttcaggcaatggatgtggggtagaagaagaaaacttcgaaggctttactctgaaacatcacacatgtaagattcaagagtttgccgacctaactcaggtggaaacttttggctttcggggggaagctctgagctcactttgtgcactgagtgatgtcaccatttctacctgccgtgtatcagcgaaggttgggactcgactggtgtttgatcactatgggaaaatcatccagaaaaccccctacccccgccccagagggatgacagtcagcgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgtagaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccaaaaaaaaaaaaaaaaaaaaaaa

SEQ ID NO: 615 - DNA, 4239 bp, Homo sapiens
gttttgtaactcaactggcctgcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatcagcatctccaggccctcctcactccggataagccagacaagtcccaggggcaggacctccaagaacagctggctgaggggtgtagactggcacagcaacttttccagaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacagcccttgtgactccaaccagcctcacaagaacatcaacatcacctttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatcaacgagaaattgcatccccagctggcagagaagaaacagcagttcagaaacctcaaagagaaatgttttgtaactcaactggcctgcttcctggccaaccagcagaacaaatacaaaaatgaagagtgcaaagacctcataaaatctatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcctgctcattgaatcagcatctccaggccctcctcactccggatgagccagacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgccgaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggtgtgctgatggaagtggaagagcctgaagtcttacaggactcactggatagatgttattcgactccgtcaatgttctttgaactacctgactcattccagcactacagaagtgtgttttactcatttgaggaacagcacatcagcttcgcccttgacgtggacaataggtttcttactttgatgggaagaagtctccacctggtcttccagatgggagtcatattcccacaataagcagcccttactaagccgagagatgtcattcctgcaggcaggacctataggcacgtgaagatttgaatgaaactatagttccatttggaagcccagacataggatgggtcagtgggcatggctctattcctattctcagaccatgccagtggcaacctgtgctcagtctgaagacaatggacccaagttaggtgtgacacgttcacataactgtgcagcacatgccgggagtgatcagtcagacattttaatttgaaccacgtatctctgggtagctacaaagttcctcagggatttcattttgcaggcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacgcaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggagaccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaagtagaaatgtcctgtattccgatgatcatcctgtaaacattttatcatttattaatcatccctgcctgtgtctattattatattcatatctctacgctggaaactttctgcctcaatgtttactgtgcctttgtttttgctagtttgtgttgttgaaaaaaaaaacattctctgcctgagttttaatttttgtccaaagttattttaatctatacaattaaaagcttttgcctctagatcgcgggcggccgc

SEQ ID NO: 616 - DNA, 2605 bp, Homo sapiens
gcatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggacgggtcaaaggactcttatgtcactgcagtgtcccattctaggattgtctgaaggccagagtaggggttggggggagtgtggacaaaccccgcaaatcagagtggggaaggtgagtggtggagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgtgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcgcaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcaccttaaaaaaaaaa

SEQ ID NO: 617 - DNA, 2162 bp, Homo sapiens
atgcgccgcgctcgctcgcgggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaaaaaaa

SEQ ID NO: 618 - DNA, 1241 bp, Homo sapiens
ggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcaaaaaaaaaa

SEQ ID NO: 619 - DNA, 701 bp, Homo sapiens
  misc_feature (581)..(581): n is a, c, g, or t
tttttggcccagaaacccgcattttattgacagtcattttcccacagagaatcttagaaagatgtcgcgttttcttttaatgaatgagagaagcccatttgtatccctgaatcattgagaaaagcaacagatacaactgacagtcacactttttaaaatcaaacagtcactaccttcagcccacacctccacacccgcatctgcctccccaatggctgtcagttcggtaaagtcaccctctccttctactctggtattaccacgagaattgaaatttttaagcagaaaaaaaaagaagtcaagttacaaataaatgagtggcgaaccaagggaagccctttgactatgatttccaattttctgttcaatccacactgcagagatacaaggataaaccaccattttggttcccaagttttattcaagaactcatacaaaattttccagataaatgaaatttaatcctcgtcttcctcctcttcttcgtcctggttaatctggaagtaacgtaattcgtaactctctttgctgttagcaactacgcgcaaccagtcacgtagattattcttcttcaaatattntttggtgagatatttcaaataccttttggagaaaggcacctcggatgtcacggtgatcttgctcttgctccttcgatgggtcacaccccttcagcaaggtcccagctttttcgttcactt

SEQ ID NO: 620 - DNA, 532 bp, Homo sapiens
tttcactgataacattgctttattaactgcgttggtggctcatttggagggcaaggggctccctatgacacaagccctggtggggccggggtctggaagcccccatgagtgagcaggacaggatggggctgggaactatgcagcagcggcaacacagaatcatgcagggcacagcgggcactggccacacccaggtgaccatacattctattgctcgttaagggttgcgcacatggacaatgtacaaaaaggagaaataggtctttgcgttaatgaaaaatacattttttctctacaaaggaatcttttctaatacaagaaaataaatattgcaacataagccaaaaataatttaaaattgctcttttcaatatattttcaatatttctcttgtatattaacaaatggcacatcactttctttgaaacaaagacagaaggtgtctcctcctgtgacattcatatcatccccccaccgtcccctcaaactgacgtggaacacaaagtgtttgtgcctctgagggagaaagtgg

SEQ ID NO: 621 - DNA, 5759 bp, Homo sapiens
ataccctgtggtgctagtgtaaaatcaaatataatctacctctttagcttttctgttatgtaattggaatgaaaaaatagtgcttttttttttttttcatttttgagattgagttaccatggagggaaagaacatgtgttttaccagtggaacgcattctttgtgttatctcttcgatttttaacattttatgtttccagtttataaactttgcctccagtttgatgaagaaaatttagctattagaaagtatttaaaatctcaaaagtatgacattttaaaatgttagcaggtttaaagataacttagtttttcaactcttaacccaaaattatacttgtatactataatttgtgttgaattacttggtattatttatcatcctagtaagatctattttatataatttgattcactttttatattgaattatgttaattgtttttgtaatacacctttcatatttcttcaaagaaaactagtgttgggttattgctaattttgcttcgtggtttggttatttacatataaaaattatattgttttaaaaattgcaaagtgatcatttattgacacatcagcaagaattaatgttgaaatgcaagttttttcccctatccttaactaagtgtgtagatatctttgttttgtttctttaatagatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagtgagaatattctactttaacattatttgaatattttaagtaacattttcagcagaaaactacatattttatgatttctgttaaatttcccaaacatttcttctagttctttcttccatgtcatgtaatttattgtgtttttccatttatacaacctaatgctaggttagaaaactgatgcttaggaagatatggtattatcttttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggctaacatgactgctagtgctcaccttggccctttagttcctgtctaagcatggatagacatgagttagtataaaccctttaaaagtcacaaagctaaatctggttctacttgcttgggtccttatcggagctccactcctttgggtcacatgtcaaaaaaaaaaaaaaaaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaacagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgccttttacattgtcataggataagctgtgttagcacttcctcaggaaatgagattgattttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattg

SEQ ID NO: 622 - DNA, 961 bp, Homo sapiens
  misc_feature (333)..(333): n is a, c, g, or t
  misc_feature (707)..(707): n is a, c, g, or t
ggatggccagtagctaagtgggcttttaaagagtatgaagattgaaagggtttttctttcttttttaaaaaaagaaaaacaaactattgatgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttngttttgtggggtttttggttttctcccaaataaaatctgatcttccaaaaaaaaaaaaaaaaaaaaaaaaaaacatttgttggggccctcgggcctggaaaaaggttttcaaaaccaatttcgtgtgggggcgcggcggcccccggatgggttagttgaacctgtggcccaaggggtgttcccaaaggaaaaccccggctccggacatcaaggggctgtggcgttttctccccccaattaaaaaaaaagcccccggggggacacccggggtgtctctggcaccccaaacccgagatggagggtcgggagggcccaatggggcgcatctatacaccggggggctccaggcgaacccccgaaattcatgaccgccncgccggcggagcgggcagaaacacaggaatgatgacgaagagagcagcgcaagacagtacacacaagagagacgacggtagacgcacatacagaccgacagagaaaatcacaaggaatagacgagcagacaaacgacaacgaaagaagcagaacagaacgacgagcgaagacaaggaaacgcaagcaaggcagtaaaaagacagaggacaacagcaacaaacacgaatcaacaagtgaacagtacaagaacaga

SEQ ID NO: 623 - DNA, 2981 bp, Homo sapiens
tccccgcccctcggcccagcctgccagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaaaaaaaaaaaaaaaaaaaaaaaaaaaaaaaaaaaaaaaaaaaaaaaaa

SEQ ID NO: 624 - DNA, 940 bp, Homo sapiens
tttttttttttttttcatttttaaaaatgtgattactggtttaccaagggggagatgcagtttatttacaccagcagccataggggaaaggggaatacagttaatcagctatctgtataggatggactacttatgcaaaaataaaaatctccaaaacaaaggacagtggtgagcttcataccctcccccgatgatcccagcatgcgataatgccaggcaggtggtcccgtgggcatgcgagtggtgggaactaattgtatggaagaaaaagccacaaaccacagaaattttaaagaaccccccccttcccccataacacacacatacacacacgacacacactcagatacataataggatcgcaggggtgatcaatacacataatcaagggaaaaataggaatgctgctatcaacaaggaaggtaggtagggaacgggagagttcctaaccactgtcaactatatggtagggagcattctctccccagaagggagtatgtaccctcggggaacctgtgggaccaagcccaccttatacccatccaggcaggaggtacgggcctatggtagaggggcagaaacaaaaaacacaggggggtaatatgaaccaggtattactcaaaactatatccggtcctccttataaccaggagaagggccgaagaaaccagtattgcggaatggggtccctatcgaggccgagggtggagggggcttcccttacatatcccattcagactgtgggagctggccaagtctcgttaaactcttttcacccatgaagtcgtcaaagcgggaaaatttcaatatttgctgccggtgattttagtaggaacttaaaaacagtgaaggccagtaagaatgaagggagcacggcccagttctaccagagtatacgaagaacacgtatgatgtaggagaaaacgtgtctcacgcagag

SEQ ID NO: 625 - DNA, 665 bp, Homo sapiens
  misc_feature (601)..(601): n is a, c, g, or t
  misc_feature (629)..(629): n is a, c, g, or t
  misc_feature (652)..(652): n is a, c, g, or t
aaccgtcaatctttaccaatttattttatacaaaacagtagcaatgtagaatatgggaatcgtcttccgctgccacgcacgcaagttgtgaacattccaagccaatgtatacaatttggaggggaaggctaaacaatagcatcaaccacgctactgaacataggaatttttcatttaaaaagattaaaaattagatagcaatgtcttcttaatattgctctcgtcattgaagactgaggaaaaataaaaagtgactttataagttttttaaaaaaagaggcaatggggaaaaaaacaagaggctgctacaacactgccatacagtcaaaccatcatacttcaatatttgcatactcgatagcagcattatttttactgaaccgtgtgcaacttacatgtagaaacacatcaaagcaaaatatcatggcagttatcaatcaagatccaaaaaggaaaaaaacaaacaaaaaaataactctaggatggacacactataagaacatttatggagaaagaatcagtatctacattcctgggactggttccattctggccccattaaagtgtccattccactggtcagctgtgggatttttgggcnggattggagttttccagttcctatgatncggcatgctgggaacaagggggncctaataatccct

SEQ ID NO: 626 - DNA, 2164 bp, Homo sapiens
cctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcatcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaacttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacgtgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaaaaaaaaaa

SEQ ID NO: 627 - DNA, 1949 bp, Homo sapiens
gggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctca

SEQ ID NO: 628 - DNA, 938 bp, Homo sapiens
tgtgcgctcggaggcgtcagctgcttcaaggatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgcagtatgttgtaagaaagcccttaaataaagaaggtagaaacctaggaccaaagcacccaagattcagcgtcttgttactccacgtgtcctgcagcacaaacggcgggtattgtctgaagaagcaggtaccaagaaaaataaggaagaggtgcagatatgttaaatttggcaggagatgaggaggttagagaggccggacaatgtgcagagagagaattctctctgggagtctaatctatctgatcagcagatagattctcggttaccataatagttccgcttctggaaaaaaaaaaaaactcgggcctttgcgggggggaagggttgacggctggccactgtccgcccttttgcaggggagcgcgggcctagggtgtgttcgaacgctagtgtcgctgcctcgcggaaaagggcccccccgacccccctctttccctgtggtgcc

SEQ ID NO: 629 - DNA, 477 bp, Homo sapiens
ggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaaacagtggcatggttcgtgccaaattccgaagcaatcttcctgctaaggccattggacacagaatccgagtgatgctgtacccctcaaggatttaaactaacgaacaaatcaataaataaatgtggatttgtgctcttgtatttttaagctgggcattaacaaaacttactaccgaaataaaaaaaatgaacac

SEQ ID NO: 630 - DNA, 3163 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaa

SEQ ID NO: 631 - DNA, 834 bp, Homo sapiens
gtgatgtctcacagaaagttctccgctcccagacatgggtccctcggcttcctgcctcggaagcgcacgagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgtccgtgtagccttctctgtggcacgcgctgggcagaaaggctaccatcaccgc

SEQ ID NO: 632 - DNA, 813 bp, Homo sapiens
caagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgaaaaaaaaaaaaaaaaaaaaaa

SEQ ID NO: 633 - DNA, 536 bp, Homo sapiens
ggtttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactgcagcaggaaaaaaaaaaaaaaaaaaa

SEQ ID NO: 634 - DNA, 972 bp, Homo sapiens
gattgcttatagaccggaagccgggaccttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaa

SEQ ID NO: 635 - DNA, 829 bp, Homo sapiens
cctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 636 - DNA, 560 bp, Homo sapiens
  misc_feature (309)..(309): n is a, c, g, or t
  misc_feature (465)..(465): n is a, c, g, or t
tttttttttttttttttccaggcccccaggagggctttattttttcttttcaacatcctgttctgcggcttccttggctctttttgcccgtatgccgaaaagccgggcgttggcacgggccatacggagactagcgaaggctttgaaattcttctcttcctcagggatgactcgagctttctccttcttatagacgttccggacgggcatgaccggtccggtcagctgggtggccagtttcagttcttcagcaaaactgtctcccttcttgggggccgagggcttctgggaagaggatgagtttgaaancggtactccttagccgtggcacgttggcctgagggactccgggaacttgtttcgctcttttggatcacagaaatgccggagggtcgggcacttttttggggaatggccggcaccctgaactcctccaggcttgagccgcgccgcggcacctttttntttggaccaaaacccggggggacgcacaatggcccggatggggacccacccgggcgcggggggaaagcagggcgccttggctgccgcccttacgt

SEQ ID NO: 637 - DNA, 2011 bp, Homo sapiens
tcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggttagccctgatcatgcttttttgtgccttgtaacccaggtcttcccaagtgcactcatccaggtccagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaatccctcctttctagctgaacaaaaatgtgcagttaatacttggcgcttgaaaatgcagtagtgaatgtggaaccaagcctgtctgtatatctggtagctccctttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagataaaaaaaaaaaaaaaaaaaaaaaaaaaaaaaaa

SEQ ID NO: 638 - DNA, 1294 bp, Homo sapiens
cgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggaaaaaaaaaaaaaaaaaaaa

SEQ ID NO: 639 - DNA, 971 bp, Homo sapiens
cactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 640 - DNA, 1243 bp, Homo sapiens
ggacgcaaccatctgcggaaaggataggggggaggaagacttaacactgcaacaacaggtacaaaaaagaaggaaactcagtaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcgcagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcggagaaagttattcgctcgattttttctgaatcataattaaactttatgataaaataaaaaaaaaaaaaaa

SEQ ID NO: 641 - DNA, 1305 bp, Homo sapiens
cctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagaaaaaaaaaaaaaaaaaaaaaaaaaaaaaaaaaaaaaaaa

SEQ ID NO: 642 - DNA, 878 bp, Homo sapiens
aggaagtgtcggcgccgccactgtccggccacagcctaacgctcttcgctgtcgtttgcggtctcggcagggcgcccccgttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggccaatcaatttcaccatgttcctgaccatgtttggtgagaagttaaatggcacagatcctgaagatgtcatcagaaacgcctttgcttgctttgatgaagaagcaacaggtaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaagtgtgaaagccc

SEQ ID NO: 643 - DNA, 2883 bp, Homo sapiens
atggaagacctggaccagtctcctctggtctcgtcctcggacagcccaccccggccgcagcccgcgttcaagtaccagttcgtgagggagcccgaggacgaggaggaagaagaggaggaggaagaggaggacgaggatgaagacctggaggagctggaggtgctggagaggacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttaccaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatga

SEQ ID NO: 644 - DNA, 64182 bp, Homo sapiens
catattccaaatctagtgctgtacttgtccctgctccgcaattatcagcagtcagatttttgtacttttctggcaacctaagcttaggggtaccaagatcatcctcctgcctttccaacagtgtttgctcagcctgcaagtgtaagaggggaaaaaaaaaaagaaaaaaaagaggtttaattataatcacttctccagggactgctttcctctaatgatgtccacatcaagtgactccaaaataattcttcattctaaaagagagtaattctggccgggtgtggtggctcacgcactttgggaggccgaggtgggtggattgcctgagctcaggagttcaagaccagcctgggcaacatggagaaactccgtctctactaaaattacaaaaaattagccaaacgcggtggtgcgtgcctgtaatcccagctacttgggaggctgaggcacgagaattgcttaaaccctggaggcagaggttgcagttagccaagatcgtttcactacactccagcctgggcgacagagcaagactctgtctcaaaaataaataaataaataaataaataaataaataaataaataaataaataagagtaattcaaggccttgaatatcaaccagagtgagtgacagaaaggcttgataccagtatgtcactcacacctttcatgggtagacctttccaaaatcacccagtgtccccctctctgaagaccttcatctgtaaaacagaaataagaagcaactgtgctgaatgttcttagaaggtgtggtcataaactctattaatagacagtagagcctgttgttaactctgtctaaatctacacattaatttggaagtttcatcagtctgactcatattttcttttttctttctaataattcagtatcccagcctttacaccctcactcaacttctggcatggacatgctcagcattgccacacttgccaataaaggtaaaaactatacaattttttggcaggctttaataactttcataatgagctaccattcctgtcatttatttgatttgaacttgcaaaggcatcagtaaattaaaagaaagcatactgagatttggtggaggaaaaaaatgtcaattcccaaattggtcttttgggaattcaaaatacacaatagagcaacagctgttctagatttccatcagagattagcagataagttattattgaaattcaaagttgtgacatctttagataaatatttgcccttgattttcacagcctctgattcaacagaaatctggaagtgttcacagcttggcccggagaagatcgttttaaatctacagctttaaaatgtggttgaaaaggagcccaggttggattctgccagcaggtccgctggccgctgttacctccccactgtcaacgcctaggtctctgcctccagccctgtttcagcctgtccttgaggatttgcttcacctcatttactgagcttgccacagattcattacctggcatcagagctcccctctcactgagcctgcccagaggggtgccagtatactagccagatgccgctggagggactccacaataaagcctggctattaaagacttcaacagtctcataaagtcactttgccagctgtagagcacacaagtgcccacagatccaagcctccttccttccccaaagaaacaccttggataaagtcttggaatatcatccattagcacatggctccagccaacacatgaattcccttacaccagcacatggtctctctttcctgttcattcactttggaagacagtccttgaaatgacaaggcctggagtgtcttgtacaaccaccgccaatccggtttccagcagaggcttgtgggctagggagtgtatcgatttgtattgttaaaggaatttcctgctcctctcagtgtcagctgaagagccctctgcagtcattctcctattttgagagaagagaaacaagaggagacgaactcctggttccttcctacggggtgtatagaccagtgacaatgttagtcctacaatttggatttatttgtttgttttctaatcaccgccacttctccaagtacaaagtctgtgtctataattagatatcttctacatgttacaccggcaagtccatctcatcattttacagagggatggtgacttcctttagcgccccatactgaccgcggtccctcacctgctgactgattgacttataaatctgccccccacccacttgtctgtccattgaaggcaaattcgccatcgggaacacagtagtttctcaataactatctaatgcatggccacccttcccaggatttagaatatcaaagggacgtgttctttcctcccaaatcacctgcctgcgcttcccccagccgggtgccccagccttcacctcggtccggccaccacctcatcccgcttcttcgcggcttccaggcctcgggctgggatctcagcccctgcctgtaggtgcggcccagagggtgcgacacgcgtcggagcggggcagcggaggaggggacagggacgcggcagccacacccgcatctctttcccctctcgggcatccccgagggcccttctgcctccagttccttgagcccccgaagccccccatgcggcaagagcgagtcgcaggaacaagtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtcccctcataagtcaagatataaaacgctttgtactgaatggcccatgatctggagcgctcaacttgggagttgagctgttagattttcttttccccacccaccagagccactcttctcccaaatgacctcacttaataagcaaaatttaaatggggtggggggggactcaacatgctgtggatgaaaagaatagttactgatttcttcacacttaatggcatgtaggagtcttttaaaatacagtctcataccaaacagatctgtgaattttaagcagaactgaattgtattaatcagttgatgggtttgttcatcttctatcactagatgagaaatacaaaggttgggaatccacagcgtctaattctactgtacttaagcaatctctccctttagtccagaaaatttcctactagttgcacatgagagaaaaattgaagcaaaaaaaaaaaaatctgttttttgtttatccatcaggtgaatacacacttcagcatcatacagaggaaaccctaggtggtctttagcaagatttcagtggttaagagctacaatttagaaaagatgacaatacatacacagtgtcaatagtatttaaacaaacatcccagacaacagaataatggttattaactatgatgctttgggcttctgactaatttcccatgtctgtctgcagccaaacagctgcaggatttttccccctttaaaaactgtttgtgcatcattttaaaaattgcatttaacagccatattctccagagcagtccctctgtgtggaactgaagtgaatggtttagcaatagcgatgaagccagtaagtagtaagaatgtctttcatgccaaaagaactctaaccactctgctagaaatgggctacatttttactctctgaaatgtagaagctgtctgctactgtatgaccttcagtatggtttacatgtctaaataaatggaattatttaaccctgctcacacttgcactagtgttttcaaaattgattaagttgtgcaactgtactaaagtgtacctttcttggggtttgaaaatattaaagaaatcaagagagggtaagattattttgcaaaattgctttctcactcttccagataaatattacattttaaaaattacttggtgatccaaagattaaaatgaatgcatttctgtacactccaaatatgcaattccaatgattatttagctactgcagctggaaatacatatatttagggatacagatatgtacaattatgaatacttgggtaattacacattgtaactaactattaatgcatggactaaaatcaaattacctccactgttttcattgttatttagtacttaacaagtatccacttggcactaaaagatggtcaaaatatatcaaacaatgtcagccttccaaaaaggtatcaaaatacttatatcctagatagatacacatatgttgtatgtagtgcatgttggtgtttcaaatatctcattatttaatgtcctgatctgatagaaatgttagatttcaaatcactgtttcacctatcccaacagttacacctgaaattttagaggctaaggagaaatgtctgcaacctacctcctcagttgtgaactcctgtacctgaaaggccaaatcctcctcctcccagcaggcaatcatcttatgccctgaagcatgagatctgattacccctatcatcatcttagcttgcatagatacagatgttattaacggctgtagtttatccaacccttttttaaaacgcagctgcagcatttgacttggggacctcctgtgaatcccactggttgactccgtcttgcacaaagcacgtggggtttgggggagggagaagagagagggaggtttgttttgttttggagggttttttttttttttttttgaatcagagttccctaaatagccactcggcatctttgtaagtgatgtgaattctgaaattacttactagaataggacaacagagtactgtgtgaactagatctgttggaaacaaagcatagtagaatgtatgatgcttttcacttcattggcagagatcaaatatgtggtcctgatatactcatccacataataaagaattgtagcttattctgaaatatattggccacattcaaactggagtacctggttttacataacaattgtttctacaagtgttgaaacagtaatctggataaagtaggtcctaaagctgctgtgaagggaagacagggacgtttttaaaatctgaaaggcctagattggcaatccaggcagatcaaattcagcgattaattggtcaatctaatcattgcctttttctcagcatctatgatttgtgtctctaagtattgctcctgtaggtcatatcatcccttctataaaacagagaggacacctcacaggtttcctataccttggaacacagcaaattttaagtactggcagaaagggaatttagaaaaaaaccctgtgaagtaaaggaggctgacgttgcacaaatactgaactatagtttcaagatgcacaaaacactgttcttaattctaattacttcactagtaagtaagtgaaattgctttaattggagcttctagaagcccttctgggaaatgagaggtagctggatgcagtagaatgcagtggaatgagtatttcaaagagcactggactcagcatcaggagatatgggttctggggatgatctctgtctctcagtgagtaagcaaggacaagttgtctctaaggttctcactttcctcatctataaaatgactacattagaggagtgccttgtaacttatgtgctctgtgattccacgctaaatggaagccaagttagactgtgtaattcacaggaaattaggaggctgaagaaagcttggcagccagtatctccctggatgtagtctgtgttctgctttcttgtttctctagtcattcttttgttttcagaaagccaaaaatgacctgcactgcttcccaaggtttggagattcagaggacctgtccctgttcccttcctaccccattgctggggctgagcaaaaatgagcccttcacctcaagcttcagtagctttcattgagtatcatcaggcaggttcactcatacattccacatttacaaagcaccactatgtgccagggtgcaagggactagaaagatgtttctacttgattattcttggagccagagaatgtcaagatgcagcgggactctagaagcctcggagtctcagcctgactttagaactgaatttttgtccaaccaagggtgtgaataaatgcaaagacatgacttgttatttgttaaggttgtggggtgaggggggtggtcacacagagcattgtctccttgttgttagcagcgttcatcttcctacttgtggggagtaacagactacttttggcaatacagtgctcaaaagtgtcaagaaaaaccctgcaactcaggacccactggattctagagaacaagcgtctcttttctggattgttcttgtttatttggggggtaaatttggataagaatcaaacaacttgtagagagatccacagcagaatcaagagcaagcctgcaaacactgtttctttcatttggcacttagcaagcacctactatgtgccagacactgctccatgacccacctcctctctcaccatccactgggcaaacaacagccataggttgaattatgatgtggaagcaaatgcaaatcaacttcctccttcatataaacaaacaaacaaacaaacaaacaaaaacttgtgtcagaatgtttttggatactaaacatcaaaactcagccaagctcagctggtaggttttcccagcgatttccttggtctgagcatctcttaactctgcatatcggtaaggggaatggtattttaaaggagtgactctctagaggttgaatggcctctgtgaggggtcgatcacaggggattggggaaggggtctctttaacaccaattccatcagctctgctagctgatgggaaagcttgtcctttcaccttcggtattttaatttagaagaatgtgtgtgtgtggagggggtgttaatggaaaaaatgtcaccgtttttagagaagctagtgaatggcagggctagcagtcaacctcagatagtctgaaactttgaggggtgctctgtacccctgcctctctcatacaacctagttaataggattctctttaacagggcactagcagaggaatgagctataatacaatacagtcctcagaggactgtagaatcagtagattctcctaacacaaggccagctttccagggcaattctggacagcctatgtcaccgcacactggtttagggctccttgtatatatctccagtgtcctgtgtttcatcccaatctaaaacatttatcatcttttatgtgtctgctccctgctacatggagaaaggagtcatgtcattaatctgctatatccccagggtctggcatatagtgggtgctcagtatttgatgagtgggtagattgatggatgggcagaaataccccttgatccatggtcctctcatgatcttatttcctatctcttggaccaaaatgtaaacatccttcgataaaagaaccttccctgcgttttaggctttggttttggttgagagctccatactcacaagcgcctacagaggaaattaggggctatgtctgaacctgtttagaagggtttcagaacctctgagggtgtggctatccccaccaccttccaaagcaataaacttatccttgtaacttaaggtcttgtctctgttaaaagataattctgagccagatggcatttgccccttatcaatcatttcctttaatggactcacaggaaaaaatctttgaaagttaagaccgaacagggtgagaatccttttacaaataacaatctggaacccagagaggtctagccactcgcctaaggtcacacagcttgttggcacagccctgaatccctatctcgtggtttccagcgtttagcctggctgtgcctccagtggcccctcagggcatctgcaggtgacttcccttcatttgcccaacatttatgcagcacctactatgaatcaggcagcatgctggggcctgtggatagaaagatgaagagccatagtctttgtcctgcaaaggctttcttctctgagctgtacccatggtagccccaagtttctacgccttaaatccgaggtcccccgtggcctgcagcagctttgcctgagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcctttcgccagggctgaatggggtgtgtgtgtattccgtaggcatcttcttgacaccatgcttgatcggggactggtgacaggaaaaagagggaagatacccattttgattttgagacaatttgatgagccttgggagtattttccagaagttttggtgcctacaaatgagccagcctggcaggagcgttcgagagtaggggaagaggtggtttggagcccaggaaagccatcgtccagcccccgcacaggcaaagcaattagtagttctccttctcgaaacagacccctaaatgcttcccctgcagacaggcctgggtctagtcatcaccccccacactgccctcatcttcgccccagataaattagttccacccttgaagttctttgtcctgaaccaaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctctctgggcgccgagttcgagaaagcgctacgccgccggtcgggctagctccacaagcggctgtacaagttggctgtcaaaaaacgctgatttctcctcctgtcacctaataaacccctacgcgcttatggcctcgtcccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcacgtgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcaccgtcctcaccatcacgcacgcacagagccacactcccatattcacactttctaactcgtaagctccgacagcgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagccggagcccagcagaggcaggagtgcgcggcctgctccctccgtgcgcttctctccttcctcgaacttccttagctgccggctctccgaacgccaggccgcagctgacctctcaccaccccgagactcacgagcgcagggctaagtgtgtgtgcgagggcatttgcttgcaccctgcctgcggaacccaagaatgtgcaggcccgagccagcgttgagcaggcgcggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttccttccctccccctccccctttcactcgccctcattgtcctgagtctttgaaagttgggagaatcggagatacttctgaggactggtaatgaagtctcacttaagtgggatgcaattcccgccctcctacccccctccaagaaggaggttgtgttttcattttgttttgctttgggtgctgacctttaaaaaattagagcaaaatgaacgtgaacaaaaagaaaaggagaaatgtttcgagctggggcagagggagcagagaaggagccctcaccgcggccggaatgcagagcggaccctggcccaggactgggtttccctttaggctcgggcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggcccttgaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacttgcgtccctcgggcccggggcagctaggaggtcggcgcgcagcgggccgggtcaggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtccggaagctcgggcgggggaatccgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagccggtggccgccgcgccgcgcgcctcccctgcccgcctttgtcgccgtccgaattcccatgctactctttttgacgggtcactggtggctctataggcaggtgctgccgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaactggaggccttcggataggtagaagaagagaaaagcaagtgttaataagtcaattgttatcaactattgttatttttaaaattaaagtgttaattaagttaacagtttaatactccctttgttttgcgggaggaagcatttctaagtccctataaaccgcttcaggcacttgttggactcttgaaccttagaggaaaagaatccctccctttctaaacggccaaatattaccctctccctgacactcctccagggtcggtggccaccccaggcttgaggggattccagggaaagttctcttgaggtggggtccatggggggtggggggatacagcctagagaaatcagtcagattcttaatttaaaaaaaaatcaggctcaaagagcactggaaaaaaccgggaggaagagatccacacaggaccaagtgtgtggaggccagtcttctagggagaaagggcttaggaaatggagggagcctgtcccaagctaacccgacagggaaccgacaacttgcgtcgctcccctctcccttgcctagtcccgaaccactttgcggagaaaataattttttcctaaaagaaataatttctctaaagcgactcaccaagcattttttaaataggtaaagcgaaagttggccaattaccactacccttattatcattaataatccaagtattagcattacaataataatcctaataataacaccgcccggcggagctcagagaaaactcgattgccttccagctgccatccctggttccagccgtgtttgtttttcttcttttcccttttacatttcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgctaatcccttcagaggtcagattgcttagcatctctctctccctctccccttttctccctcttctccgccctcctttccctctcgccccttccccccttccccgtctttcctgcgatttcaggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccaggtaccttagccagggctgcactgctgggctccgctctgctgcctcctcactcttttgtttgtgccaaggcctcctctgagtttccacgcagttgaggagagacccggccctgacctctcccttcctctcccctccttcttgcctcaactcttggaggccctttggctggggaaaggcgggaagaggtaagggaagatatgagtttacaggagggagtctgaagtcctagagcctccctacacttttttaaattattattattctgaaagattttgacactgggtaaggcccacaccctgtggctctaaagccggcccaagggacctaaagaatttagcatctaaaccacaagtagcaagcaggagaaagagctttgttattgtgcctgcccaccccacactcactcctagcagcatcaagctcagtcccctgatcacttgcctgggatgcagaagtaagcggcacacagacatctgagtcaaggtcaccaccacctttagctgagaccaccaagtgagtgctagccacttggaagagaggccgtgctttctgaagggttgtgcattttcaactctggagaagcagggctgctctggaagtgggcagtgggaatccagcacccatgtgaccttagctatgccttgtcagaaaagggcagggtgaggaagaagagaagattcaaaaggaaggtgcaactgggaccctcctcaagcttccatatccctgtcctccttctctgcttagaatttgggcccagtcggttgttttggtcttgagtaggcagaactgtctcaaagagacagaggaatctggcatgggctgaatatgagccaaagcttctagaaagagtgagcagaacctcttgactcagtttccagctcaataataggctgattttaactaaggagatcaaccttctggtcctacactttgccctctccttatcagcgactcagaccctcagtacagagtcctccatttcacttgtggaaagatccctgagggtgcattagtcagcagtcatcctttggtaacaaaatagtaaaacacttttcactaattgatatatatagggtacatgtatacacatgcatatattgtctgctgctagtgaattgttctgacatctttttctgaagtcatgtctgctcatattgttttctaatagttttggattaaccacaaaaacagaagatatttgcattgagataaattttgagctctctagccctgttacctgtttaattggctactgtatcagtttctagcttcaccatatggacacatcacattttacacgcataggactgtatcccaataactccacaggattgtgcgattactgcgggttgtcagatttgaaccaacttctacttagattgtcttttgcttttatgcagtgaacagaattggaaaatcaagatctctgatgttgtgcttgatcttttagaaggggatggctatcaattcaagcatattgatatcagtccaagtgcttgtaaaggactgataatagactcatcaggcctggtgttcttcttgcaaggagagtaaatgatcagagctgaggcgtttatccttctctctggcgctagatatttatatacatttgatctgatttgaagacacacttaagaacttatgaaggtttccattttgcatttgcatacttataagaatactggaaagataccatctgaggatagatatataattacatttaataacaagttttaaaaaacctgtttacaatgaactattacattggccagcaaagatgccctaaataattcactttggacccaaaaattatctcctttctctcttattctaggattaaattatattccaatttattattaacagtaatgaggacatttagaaatggatatgaacatctgtcccacctttattttaaataaatcatcataatttaaattggagaagtgtgaactcataaaactgcattcgaatgtgtaattttcccctaaagggcttcagggggaagaaaaacatacttactccaactccagagtatatgaatttttgagattatgaagcaaaataaaaatacatttattatctttcttctcactacaaatctaacagtagcaacttctataaatataggagagcacacaatgtcttaaatattttctgtgtataaaactcatgcacatgactctttatgtatctatgcatatgtcccctcggtaatgacatctaacactgaataaattccaaaggaaactttatctgtagatttcctctttcaatggctaatgtttttacagaaaattgcattaggtaaacatctaatttctcatgcatctcagataaatatttctaaagaagtgactacctttattttttcagttactatgctaacagtctgagcccatattatcatttagtctgacagtccatcacattaccttcctggtcctgtttacatggtgagcatttctatattttgctcaagacttgagctcttcctttttcaccctcatcttctctaggccttgccctcctaaactctcaccttccaggaagggctgtgtttctatgcacctgggccgaggctagtctttaaggcaactctcaacttgctgataataaggttggcttcatacaaaagcaaaagtgaggtaataggagagtgaagaataaatgggagagatttatctgatagataaacgggctctcccagaaagtggcagaaagaggtagactcaagtactgaaagcagaaagaatcgttggtgggagggcggtatggtgtgaatcctgacccaaaagccagctcttaacggaaggaacttagtggcctctttctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtccgggactggccctcttgaagtagcctgggacgtcccagccccttctcgatctggccctgctcatgcccaaggccctcgcgttttgcaggcccaggctcggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggccacccttaagcctgctagcctgccccaggatcttaaaatctggatagtctcacggggaggagatcatacaggctggaagttcgcggtgtgttgaaaaagggagggcagagacgcgaaaacgcggaatttccagcccgtgtgcaaattctccaagatgccaaaatcagtacggccattgggccgatgtgagtccagggccttctctctgttctacagaaaagagggaaagggggctggagaggcagggtaacgcccgtgggtgcctcggacacccagctctcccaaggctcttaagcgcgcaacagcaagaaccaggacgtcagagtgcttcctgggcctggagcacggtccgagctgcgtcccccgctgcagcctgtcgagggcgccccaggcccaggcagggggcgagggtaatgggctggaggacaccgtggggcctgggaacagggtgcgagtgggttttgctgtgaggcggcccgggccgggtggcagctccaggaggagagagagccccttcctctgcggcgcaggaagccggagggagcgtccaacctgttgaacttgtgtattgacaagttgtcaagctcggcaggccgaagattgccctgaattaatttgtttgtttaaactgttggtggtaattgtcacatctcccctgcctttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatcgtggcactttgagcacgggcccctcttctaagcctcagcttccgaatctattcagtgtagtggttagacgatctcagaatcccttcctccctcagattccctctcccttcttcttttcacctcttgggcgattttgcccgcccagacttgacattggggcggggctggggggagagccgcagcggctgtgtctcgacgtctctaatcgccggcatgcgtttctctgtttgcctctgcagccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaaggtcagcggccttgctgggcccaaagagactcgtgccagcgaatggagagggacgcacccagttcttctgagctgtgtgattggggtcaggcaaactggggagagaactccagggtgcttggcgggtctctgcatggagctccagcccttctgctctcccttgttcagccaggggtgctcaaacttgagtgtacagtagagtcaacctccgagtggctacaagtgtgcactccggatcttatccccccagaaatttcatttcagcaagtttggggtggaggccaggaacctgcacctttaggaaacacccactggtaatgggtggtgggtggagacctcgtctaaacccagagggcagcctcaggtgttcctaaagaccagaagaaccaacgttcatttttagaggagaggaattggctacagctggaggaagggctccagaattccaaatcttggcatgtatgatcttgggcaaagccatgagtttctaacgcaagtgcgaaatgtggagatcacactgttagaacagtttgaggaatctgagttcatttcccatgctcccctcacctacttctgaggcaggtggatttacagcagggttgattccataggagcagggccacagcctgaaccacctggaaaggctgccacctaaggcctaccctccaggcctacagctgatacctactaacacccccactccaggctgatgagggcctaggatctccctcagaggagggccagctgcagccccacactgcagggaagccagacacctgggcacatgcacacgcacaatatttaatatggctttcttacccttgatgtgtataataagctctggaaagtagtgttatgaatatgttgtcagttatgaatgggaatgctctgtgaatgattaagatgtctaattgaaatatttccataatatactaatcctttctaaaaatactcatatgcatatttgtgtttgggatgcctattaatttatactttttcacatctatttttatttacacaaatgcaagcagctcttgtctaaattgggagccaggcttggcacttggctcagcccaaggaaaatttgctgcaggggatagaaaagccagagggccttctggaagggagaggctcccaaagagtggaaatggacctcccccaaccagtattacttttcaaactctatagacagcgatgtttgatttttttacccaccaatgtcaactgcatgtttaaacaaaacatccaaattcttttttatccccttccttgctttaattagaaattaaaagtttggttcttcttgcaaagctgtggtttcctcacttccaggtgtctttctttcttccctacccagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccaggtatgaccacactgaggccttgggagaaagagagctgggaaagaagcagtagcactcagccttataaaacttcctctatccctgggtaaaccacccaaggcaggcatccattcttaatagcagtgaggaaactacttgtttttacttgcttcttcctgtgggttcaaaatatctacctatatgatccttagtaagaaacgtaattacattatttcagaaaggatgggtccagtctgtgaaaacacacatacaagaacattacctctttttgtttgattggaacagcaaatataatctcaaattttaaaattgtaatgattttctaaaactgttgatgaaacaatgttttactaagaacattggaactgagagaagtagaaggtggtaagagtatgccctcatgagatttttcagaactgatgttattattttatattcccagctttatattctccattgcgatgctcccagttttggtcattaattgataagcatgtaaaaccaaagggcacagtgcacacctcctgtaggctaggttcttccttgattcttcatgtacttttagacattttgtaaacaaataggcattttgcttaattccgtggttgtaaatgacattcaggggaagaaaaagtgtgtgcagtgaaacattgtattgtactgagacccagaaattttgttgataggaatattagaaatgctaacatttttctaaccttaaaggaaagaaagaaaataaagtgttcccaaccattggctgttaccagtgcattcacaggaattaatgacaaattttccaaaggctaataagtagttctaaaagcaaaggatttatttcttcaattcatttcatacctaattaaagcataatagtgcccctttatatgaagtatgtttcctacggaaagatcgggcaatgtgctaaaagcatttcattttctagcatgagatgttcttgttttcatggcctgccctttcaaatatggccagaattaaatattgtttaccttgcattttataattatttcctgtacttgatggaataaaactaaaaataaaacattaaaaaaattaaaccctttggtctaattgtgattttggttacaagccttcatgattcagctcttagctcccaaaagaaatccttttacataaatcatttagagttgactggcttttgagttttgagatttttaaaggtagttaggtcctatctttgaccaggtttactggttagctctaaccacttcctgtgtgtgtgtgtgtgtgtgtgtgtgtgtgtgtgtgtgtgtagactggctattttttttcaaaataagtatttgtatactctcacccaaacaaaatttacttactgtctgccacttagccctttggtagaaatccttcgacaacaagcaacctgcagtgaagtggaatctggtatattaatttggaaaaagagacagattttcattttaaatattcagtagcacattttattagaataaaaatgacaagcaccttgatgctgtccatttatgggtctcagaaaaatcaagcagtgagacgaggaaaactcagcaaaacccgattaacataattacaccctgatttcccccagtgcctcttgggaattagtgatctctgtctctctcccagcccagccccctcaaccctccaggaagatggggacccagctctgcaagcgtctgaggaatcctcaaccctgctaatagcagcattctctgtgaggggaatccacctgctgagctgctggcatttcataaagcctcgctctctagaggagcttctaggtggtcaggaatgggtggatacaaggacaagaggggcaaatccttttctgagagaaggaaactttggagaattggaatggctgactctcaaatccatatgcatatctataggcaccttttcaaaaggaaaatatgggaaaataagggaaagctagaatattcagaaaaaattaccaagacaggcatttaaaacactttttaaaataatggaaatttacatagtgaaattgtttataaatttataaattacacactatattatattatacatctattgtatgacagctgatgcttttggaagatgcttggagagaactgtttgttctaggaatagcacaatgggccattccggttgatgctaacactctactggctgtatctggtaagaattgcacaatttaatgactttgttgtagaaattaccataaaaatacattactgaaaaaagaacaacatgtaaagaataacaaattcctgctgaacaatagagtatacctgtcatttataaatctatatttaaatgcaaataatgttgttttgttgtattcatgactgcttgcattgttatttaaatgcaaattactgtgtttgttatcatccaagagaagattttatattaactttcatacaatatagccggtttacatggaatcagatatcttagagtgacaattgaatagatattgatatgcaggattttgtcaaaaatcaatattaaatcatgaaaatgccttcatattagagtatttatcccatatttttattctaggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccggtaagcagacacagacccctgtttcttctccttccccagttttgccacctcactaattcagccacctcgaagtctgaactgacctttgcaaaaagaggtgatggttttcaagggagctgatactcttaatctggccccattttttattgctatgggaacctgcatgttctgctgggcatcaacttccagagaggtgcattcccagacccaatttctttttttctttctttttttttattttttaaatttttgtggagatggtgtcttgctcttgtcacccaggctggagtccaatggcaccatctcagctcactgcaacctctgcctcctgggtttaagcaattctcctgcctcagcctcccaagtagctgggattacagacacatgccaccatgcctggctaatttttgtatttttagtagaaacagggtttcaccatgttggccaggttggtctcgaactgctgacctcaagtgatccgcctgcctcggcctcccaaagtgctgggattacaggcgtgagcactgcgctcggctcccagatgcaatttctatgctgtctatcacagtttcctggtcttcatttctagttcctacacatagtggttctgaactgagaagtttccggaatgctgccgccattgcagcccttcaagatgaggctcagctaacgctcaacagctacatccataccaggtgacccttgtttgccttgaacatgtacttaagaaaattgcctccattgtgaatgcctgagcaggcggtaataagccagttcaaacattgtgactaattatcttgttgccagccagttaatttagggagaatccatgtccttacctatctctcagggtgggtgagaggagcaaatctaattagatgatcaaagtgaaagcactgccagacatattacagttgtcctggcggaacaaattgatccatcaaaataatggaacaacatttgtgtgaatgggtatggaggggtcaaaaatgaagcctaggctgggcacagtggctcacgcctgtaatcccagcactttgggaggccgaggtgggtggatcacgaggtcagaagatcgagaccatcctggctaacacagtgaaaccccgtctctactaaataatacaaaaaaattagctgggtgtggtggtgggcacctgtagtcccagcagctactcggaaggctgaggcaggagaatgtcgtgaacctgggaggtggaacttgcagtgagccgatattgtgccactgcactccagcctgggcgacagagcgagactccgtctcaaaaaaaaaaaaaaaaaaaaagaagctcaaagtgtaatggttggtatgtgagagagtggccacatcatccttgagaaaacacaggtgactttcttcagatgccaatctcaaataaaaggatgagagaactttccagagaggctatctttttttttgagacagggtcttgctctgttgcccaggctggaaggctgaagtgcagtggcatgtgagcatggctcactgcagccttgaactcatgggctcatgtgatcctcccacctcagcctattgagtagctgagactataggtgcatgccaccacacccagctaatttttttttttttttttttttgagacagagtttcactctttcacccaggctggagtgtagcggtgcaatctcggctcactgcaaccttcgccttccgggttcaagtgattctcctgcctcagcctcccaagtagctgggattacaggtgcctgccaccacgcccagctaatttttgtattttcagtagagacggggtttcaccgtgttggccaggcaggtctcgaactcctgaacttgtgatctgcctgccttgacctcccaaagtgctgggattacaggtgtgagccaccatgcccggcacacccagctaatttttaaactttttatagagacaaggtcttgctatgttgcccaggctggtctcgaactcctggcctcaagtgatcctcccacctaagtctcccaaagtgctgggattacaggcctgggccactgtgcccagcctaaagaagccatcttttcacctatcataactgttgtttggccttggtgactggtatctgttattttgtgtcataacatctaccaggttacttctggccatgcagggcccacaggcagaggctgtttttggctgtttgtaggaactctcagagactggggctccaacaaagctcctcctggcccagcactgggcaagcccattaagaagtatagactgggggctgaggtggctccacacctgtaatcccagcattttgggaggccaaggcaggcagttcacttgagctcaagagttcgagaccagcctgggcacaacatggcaagaccccatctccaccaaaaatttaaaaaaaaaaaaaagaagaagtgtaaattttattatgccatttaaaaaaaaagccaggcttttaaagagaaatggaaactttctagtttcctgagttaggactggtagatttgaagttagaatagagttactcttctctaggctgatttgaaaggaatctgtgaaagctcagctccataatctcaacatcagctatagacactgtggggggaataaatacatcaaatgggtagaggctgttaatgcctccctcaactaatgggtcagagaaatcccaagtcaactctgtccatttggggtgataccacttctgctagagtctctctatttctatcgtaaacctcttttgaatactaaatgaataaaactgttccctgtctatggaatatcactgaaactatgttgacagatagtgcacctgtatatgttttttcaaattaaaatgccaggatttgaattttaaatgcatattgaattacagaatatatatagtaggcagttaatatttgttcaaatttattaaatggagcagtacataatctgggtacttctactgacttgtaggccgggcacagtggctcacacctgtaatcccaagcactttgggagttcaaggagggcggattacctgaggtcaggagttcaacaccagcctggccaacatggtgaaacccgtctctaccaaaaatagaaaagttagctgggcgtcatgacgtgcacctgtagtcccagctactcaggaggctgaggcaggagaactgcttgaagctgggaagtggaggttgcagtgagccgagattgtgccactgcactccagccccaggtaacagagtgagtgagactccgtctaaaaaacaaacaaaaaaattaaaaagacaaaaaaacaaaaacaaactaacttgtatgtcctaactgacctttgacatttagagccattatggtattaagaacttaaaaatgagaaggacgtggtatccagttattgatccagtcaagcctttgccgagtactggccacatgcagggctgcaggtgggcgatatgggataccagaaggagcaagacactgccccttatcattgcaagaagtgggcagcagtgtcactccaatccaaactagagaagagaggaaagcaatgtggggagtgtgacagatgaatcctagtcagagggagtgagggacaatcagaaaagctcaaagtctgatgggtggaggaaagaacatgtgaattggtccttcaatgggaggaggatttcagcaggggagaagatgtgtcctgagagtggtggaggagctggtaggggtcctgtgggaagtgccagagaggtgagtgaggaggggagcctggtgtgccaggagctgctgatagggtggcccgagagaattcaaccatgggttaacaacagcctattttagagaaatggcaagtaaagtacatctccccaacaccgcaaaagaagaaaattatgtgtggaaaaaacacatctgctttgccatggaattcttattatttctattaaatattagaatagtaaatatcaaataagtatcttatttcttattaaataatggaattatggaatttcttatttcatggaattcttatttcattctgatatcagctacagctgtaatttaatatttatatctagggtcatacatgtgacaaaaatgactatgccttatttcttagcccttcaaatcagtgaacactttttcctccagcactttcctgtctagaaaaataaaacctgaacttgaaatgaaaacttaacatgcaaactgaaactgagcctaattgtatattacagctctctaagctatttctctaattatcgaggacgtaaggagaaggctaggaattgacattccacacaaactatattctataactgaagatcaaatatgcaaatctgtaatagacctaaaacacttaaacctaaaagaaaatccaattattgatgctaatggatgaagacaagggcatagatattctaaaaaataattttgattagtcagaccttctctctctaacacacacacacacacacgcacacacacatacacacacacacacacacacacattgtttttgttttggatgcccaggctgcattgcagtggtgcaatcatggctcactgcaacctctgcctctgaggctcaagcaattctcccacctctgccttctgagtatctgggactacaggtgcccagcgaatttttgtagagatgagcccttgctatgttgcccaggctcatcttgaactcctgggctcaagcgatgctcttgcctcagcctcccaaagtgctgggattacaggtatgagccaccacacctgacctcatacattgctattgtttctggtagtagtacagtatgctatatgtaatagacaattaatttttgttgactgactaaccaaccctttcccaactaaagaataaaataagtgggagagtagatgagtgggtaatctaatcgcagaaaatcaggagttggttgtctatagattcccccaaattcatcctttctgaaggtgattatttctcacagtggtttctcaccacgggaaatgttcagcatgttgggtggatgctgcagatggcagaggtcgtccaggcagccactgcctccgacttgctgaagaattatctctactatgcctggtcctgggaagggaaatagagctgttgaaaagaagtggccaaggtgaaagggagacacggatttggggattactttccaagaaacattagaaatacattaaacaaggagaacaagtggtaggatttaagtatttttttttaatgcaggtaagcttcaccatttccacaccacactactagatgtggtctggtggcccctatctgcaggtggtcatgaagctgggcagtgaaagagccagctgaggtcctgagaggcccagatgaactataagccttgtattctgtggaagtgaaggactcttatgtgcccagagctaaatatttagacaagcatgaaagttgctcccctgaactttatttgcagggtggagttatcaggcagttaaacacagccacctgactccttcgaaggaattttgatatcccttagcttctagcaccttgtggcctgggttgaacccagcttagtcacagatgtgtatcccggaagttcaggttttaggtgtttcatttcagtggagggagctctccttatgtatattgatatctaattctaactattggctgaagaagtatcagggctgcagtgaggaggtggcttgcaggcatctaaaggcagcagaagattgaacttgcacatctgagcacagatatatgttggacatcaaaagaggaaattgttaagcaatttctcacatctttaattacatgccaatttcattgacatgagagttgggtggcactgccacccaacagaacttagtctttaatttgcagtgtaataaggatggaattattcctgagagagactaagtataatgcctgaataataatttggagaattgcttagaaaaagaagccattttatttgagggaaatagccttgaggagtccttagaattagaaaacatgggttctgttgctagccttatcctcaatgccctggtcgttttctataatggaaaccttaaatttattatttggcttaaaattagtattatgcttcttaaatttctttttttttcccaaacaaaatgcaatccatttgttaatgtagagagggtgtccgtgtgattttggcagcatcatttatggtctccctgcctcaagtagtctacctgcaaaacggggacaacagtgcctgtccagaactttgctgcagggatactgtgttattcaagagacctagatcagcaatgctggagatgatgtgtgttcaagtgtaagacgttagtttccataagtaatggcctctgaccttgttttcatggcttctcacattccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccagccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaactctttctgatttcttaccctccctccctggctggttctcacccaccagaaacaaggtaggggcagcagctggtgttaaaactgaagctcggagcactccagcacagagcctgcagaactgaactacaaaggcaatttccttcttacagtgaataccatttggaaaatgatgaataaagaaataaaacgtaagattctgttctctacagctctcaaatgtaattgcatctgttagaaaaattgctgtgtgaggaggaaggaggccgattaacagagtcttcattccttcctctgtttctaactctcttgccaacatttcaatcctgaccagtcacttgaaatcatttaatgatcaaaaagataaagtatgataaagttcatatggtgagtaagatgtggagggagcagtagaaatgtcatccagatgttcccagcaagtcttaaggcaccggtcccacaagcaaaggccatcagaggtgcccaaggccacaggcactgtagactccttttgggtggcagctccagcaagagatgcttgtgcctctgctcttgctaaaatggtcttgcggaccgtatatgtgaaatttcaatcagctgtgcacttcttgtctacttattctacggagaatgagaattggtcttaaagaaaagcacagtactcaaagactgtgtaagaatgtcccttgcaacactgttcgtatttaacaactttagtatccattgacagataataggtacattgtggtgaatacagacaatgttaccgtaggcaaagtgaatggctagagctaatgtatcaacatgggtaaatctgaaatacagtgtgtttgtgtgtgttatggggaaagtaaattgcagagggcacatacagcttggtatcatttatataaagttttacaacctacagaacaatactagacaatgtttatgggcatataaatgtataggaaacatttaaaacaggcatgagtattataaacactaactgctggatagtggctacttccaagaagagatgggatgggtgaagggtataacaggaccctcaaatgtttctgtaatggttaatttcataagaaaaaaatctcaaacaaatatgagatgaatgacaagatttagtaaagctgagtgatgggtccaaggctgttcatctgtgtatcagtcaagttttccttcaataatactgaataacaaacatccctcaaagcttacagcaacaaactcttataacttgctcacaggactgccagcctcatgtggctgtgcagggcttggctgggctcagctggagctgactccaggctatagtttgggtttaatatgctccagggagtctgggggaggtgactcacacctataatcccagcactttgggaggctgagacaggcagatcacaagcccaggagttcgagactagcctgtgcaacaaggtggaacccagtctctactaaaaatacaaaaaattagccaggtgtcgtcatgtgcacctgtggtcctagttatttgggaggccaaggtgggaggatcacttgagcccaggaagtcgaggctgcagtgagctgtgatcatgctactgcactccagcctggtgacagagtgagaccctgtctcaataataaataaataaataagcttcagggtttcctcatcctggactagcagctttcctaggatagcttcttttcatggcaacgtgcagaagtgcaagaggctgatgcaaacacatttacagctgctactcacttcacattgcttactttcccccggccacagcaagatcgatggtcaaccttcccaaccttaaatgggcagagaagtgcactcctcccgtagaggtggagtgaggagagaagattcactgaactataacaaaatctagtacaatcacaatctactttagtctattataaatattctcaggaaaattaaaagggagtaagattcttgtgacaagccacagaatactgattcctactgggattgcttttcttttgggcatctctgtcattatttaaaaaaaaaaaaaaaagcaagcctggctttcaacatttgagaaggcccagaatttaaagctcagtagcagatattctctatggctggtgttgtgggggaggctcaacagtggtccgtgaatacacaagttcaagatatacaatccaaatggacaaataagagatgcattcagccaaatgattattccagtaagaaagaaaaaattgtcttcaatgcttctcctttttttttttttttttttttgacagagtctcactctgtctcccagggtagagtgcaatggcccgatctcggctcactgcaacctccacctcccgagttcctggattctaagtgattctcgtgtctcagcctctggagtagctgggattgcaggggtgcgccaccacgcctggctaattttgtgtttttagtagagatggggtttccccatgttggccaggctggtctcaaactcctgatcttaggtgatccaccctcctcagcctcccaaagtgctgagattaccggtgtgagccaccatgcccagcctaatgcttctcctttgataaatgttttttctaaatcttggagggtcacttttcaaaagtgttatttacataccatggctattagatatgatgtcttacatttgtgtttaacttacttttagttatcctttgatacaagagaagagagagaacaggcggtgagctcagtctctgaattgagactcctaaattattttacatatagctcaaggttttcaatccaatgtaggagcccaagcactgaatccattggccagagattactcatggctgcctttcttaaacattttataaaaatggaaacactacttttctgcaagtttcttttttgcctaaggctatctctcctgatgaatacatatggctctacctcattcaatttaacatctatctagtattccattttaaggatggaccactgtttacccaactaattccttgttcaggaacttgggttgcttgcagtgtttcactataataaattaaactgcaaagaactcaccttccatatacacttttgtgggtttgtgggggtgtttccgtaggataaactcttagaagtggcatttctgggtcaaagattatatgcatttttaattttgatagatacagccaaatggctctccaaagggttgtatcaatttgcactcctgccaagagggtatgagagggcccatttcattgctcagaatttaaaagtgcttaatcagacacaggcttgatgaacacttcagaagctgttagaaaaatacagagaatgcatatgtttctattgtgaatatgcctctgctacaatgcttcctggactcattaagtaggtcccaccctgtactgatagagcttggttccaccaaatttttagcacaggccacttctaagaacttttgggagtgcccatgctacagtgaaggtttagagaaagggtaaatgaaaatgtgaaaatgtagaaccaggttggctgaggctttttattttattttaaaattttaattaaaaaaattttttttgagatagtatctcactgtcacccaggctggagtgcggtggctccatctaggctcactgcaacctccgcctcctggacttaagtgatcttcccacctcagctcccaagtaactggtactacaggcatgcgccaccatgcttggctaatttttttctatttttttgtagagatgggggtctcgccatgttgcccatgatggtcttgaactcctggactcaagtgatctgcccatctcagcctcccaaagttctgtgattataggcatgataatttttttttttttttttttttgagacagagtcttgctttgtcgcccaggctggagtgcggtggtataatcacagctcactgcagcctccaactcctgggctcaaggacttctcccatctcagcctactgagtaggctaggagtaaatgtgcatgccaccatgctcagctaaattttttactaaatttttttttttttttttttttgtagagacagggtctaagctatgttggcaaggcttgtttcagatcctggcctcgagtgattctcctacctcagccccccaaagcactggaattacaggtgtgagtcactgcacttggctggctcatgctttctactactaagatgctgctctaaggatcttgtactatgcattttacaataccttttaaaaaacaatcatttatggaaattgaagaacaacaactctctttaactgaataactccagtacctttaccacaaattacaaatggcttcttttcaatgtagtcttcatttttaataatgttttcagatttttgaaactcattttgtaacattgctgaatattgaatattgctgacctcaatatagaccatcagggagtctcatcagagctttcaccacacactgttaggcaggctcggcagcaatgtagcagagggcagactctcagatgaagaaacaaggatgttgtcacatatcctgggcatcttcatgatgtgccaagatgttgcaatgctctgctgggaaaccatgggtggagtcaatgtattgaggagactaaggtcataggttggattttcaggtgaaccaggtggccttattctgtccatggaactggtatctctaatatctgtcaaacactatgtcccaggaaactgagcaagagtcaggagagacctggactcttctaccatgcagcctagaaaatagctcacagctcctgacccctgatggtcagagcagagcatcttgtttgacacagcaatgggcctagtagaaggagcattggtcagggggaagagactgagtttccagctgtgaccagtgtgatctctggcaggtcagctaacctgtttgcacctctgggttttcatctgtgaaaggagtattaggctcagtgatgtctaattttcctccttctgttctaaaatctcatcatcatctttaactggtgtggtgccaggagaccctagaagaaattctcctttgtgggaagagttaatcagagtgcccaggtgcagtgactcatacctgtaatcccagcactttgggaggccaaagtgggaggattgcttgaggccaggagtttgagaccagcttgggcaacatagtgagaaaaagaaagaaaagaaagatgggaagggaaagggaaagaaaagacaggaaaagaaagaaaggaagaaaagagagaggaaggaaaggaaaggaaggaaaggaaagaaaagaataaaagaacaaatcagattaagcacatttgcaaatgtgttcaaccttggccacttgcttcttttaaactggtccttctcaatctttgttgcacatggaatcacctggggagtgttaaaaatgctcggtgcccaagctgtaccccagatagattacactagcatttctggggcagggcccaggcatcagtggttttttgcttgtttgttttttgagatggagtctcactctgttgcccaggctggagtgcagtggcgctatctcagctcgctgcaacttcctcctcccaggttcatgccattttcctgcctcagtctcctcagtagctgagactacaggcacccaccaccgcacccggctaatttttttttttttttgtatttttagtagagacggggtttcaccatgttagccaggatggtctcgatctcctgacctcatgatccatgcgcctcggcctcccaaagtgctgggattacaggcttgagccaccgcgcctggctggcatcagtgtttttaaagcaattccagtgtgcagctaaggatgagaagcaccgatgctggcctttggtcaagaatcctggaaaaggggcttatcttcaggctccagagtcatctgtgctctcatccgtcatgcctggttgctctcccccctactctctggtgaccttttaaaaagttaattctttcccctcttttttgctctggcttgtcattgaactcacccagctgattgtggcgcttatgattgagaacctcttctgaccgcttccctttccccagaaattaacatgatcattaaggcttataattttactcaccagtgctatcaatcaaggggctgcaaaaaggagttaagagtccttttgtaattggcagcagcctgtgatttggagcagagcatccagggtctgtgggaggctggaggtagggagggcctggggtgcagggagggctctgtcccccttgagctgactcccaaaacttcccccaggggctagaaagcttcagtcttcctcttccctgaatatcaaaataaggaagccagttcttgccaatgggactccaggctcaccccaagctctgcaataggaaggaaggtctctcacagcatccctgggataaggaagatcagagaattctgtatacactaggcaacccatgtctggctgaggaggggcagtgggcccagattatctgtagttcagaagtggggttgagactgtcagacccaaggaggtgatccatccttccctagtctccttggaactttgtttagggcaacaaaaatggcagctgaacctgatgcaatgcaccctctgcggctccccgcagcccaggtaactccatgctccttccacatgcagcgagctgcagaatcacagtgccccaggacaagggctgaccttcccttctgggagggctgggctgtctgaagacatttctgacccatgcagtgccttgtggaatattttatagatacatggtaagtggtatgtatgccagaggtgatagggtagttattctctctctctctcttttttttctgtttttgagacagcgtctcactctgtcacctaggctgcagtgcagtggtgagatctccactcactgcaacttctgcctcccaggttcaagctattctcctgcctcagtctcccagatagctgggattacaggtgcatgccaccatgcctggctaatttttgtattttttagtagagatggggtttcaccatgttaaccaggctggtctcgaactcctggcctcaagtgatctgcccaccttagtctcccaaagggctgggattacagtcatgagccaccacgcccagccctattttatttcaaatacaacattgtaacaacatgaaagtgatttatttttattttcattatttatttatttaagatggagtatcactccgtcgcccaggctggagtgcagtggcgcaatcacagctcactgcgacctccgtctccttggttcaagcaattctcctgcctcagcctcctgagtagttgggattacaggcgcccaccaccacgtccggctaatttttgtatttttagttttgtattttagtttcaccatgttggccaggctggtctcgaactcctgacctcaagtgatctgcccacctcagcctcccagagtgctgggattactgccaaagtggcatgagccactgcatccagccttttttttttttttgataacactataggaaaatctggagagggataaatcacctataattctacttctctaatacaactattttatttttgcctatttttttctatttcctgcacatgtacctatgtattttaacataattgtaatcagagtaaacatgttttgcattctgatagccctcttaacattcgatcactgacattgttagtagtggttatgaagtctagaattccttttggtgtttgcataataattctgttacttggtgtgtgccatcattttacctgccactcactgttttggctaattaggcccaacaaaaatgtttaaggaaatcagttcgcaatatacgaaacagcatgactatgacttacccgtggagattagattcccagttcttacctcctaagagtgggactcagcaagtgtgaggtagggccctggcacctgcatttcacaaccctgatgccattggtcctcactctgtacttcctgaaacactgccctgaggcttgctgagtttcttcagggaccatcaatgataggggcttggttacagccaccacagaaacaccaagagcagttgctttcatcttcctttccaattaacaccaaggttgggcagaagattagagttaatatctcttcaaaaatcgtgtgtaggggctgggcgcagtggctcatgcctgtaacccagcattttaggaggccgaggtaggcggatcacctgaagccaggagttcaagaccagcctgggcaacatggtgaaaccccatctctactaaaaatacaaaaaatataaatagctgggcgtgttggtgcaaacctgtaatcccagctactagggaggctgaggcaggagaatcagttgaacccgggaggcggaaattgcagtgagcggagatcccgccactgcactccagcctgtgtgacagaatgagactgtctcaaaaaaaaaaaaaaatatatatatatatatatatatatatgtgaaatacatatacacgcacacatatatatgcatatgtgtgtgtgtgtgtgtgtgtgtgtgtgtgtgtgtatctcacatgtgggtggaccaggtgcggtggcttattcctgtaatcctagctgcttgggaggctgaggcagaaggatggctagagcccaggagttcaaggctgcaataagttttgtttgtgccattgcactccagcccaggcaacagagatcctgaccctggaaaaaaaaaaagaagaaagaaaagaaaaagaaaagaaaaaacaacaacaactgtgggtcacactggagctgcttctccacggggctgttctcccccacctgggcactggctctcctggaaggccgtgccgcaggacatgtcagcaccttgtggctctaggtcacatctgctccaggtgcctttgttccagtaactcaatactcagatgatggggtagtacgaagggcccacattttgcagctggtggagatctgggcagtcagcacagggaagggggcagtgagggatggcttggctcatgctgggccttgctcctggcagcccgggcctctctctctgcacacacaggctgcacttgccagcatctcttctctcccaagccgaaaccgtctggcagtctctttgacctgttcactttcctcctctttggtgtcttggtggtccagaattatctgcagaaaggaaaatgcctgccttaccttcctttatttgccttaaacctcccaaatctgggtctagcccagctataagcagaggctgagcaagcaggccccggagtgaggctgggcccagaaaatggctccagaaaccaccagatgaccacgagtagactatggtgagcacttggagtaactgccatatgattccacccaaaatctggctgcagctcaacttctttcagaaagagagagggagctgccacgtctgaaaaatcaagtcagtgaccagcccagccacctgccatgtcctagcctgagttttgtttcagggccacggtcatgaacttattcttcgctttgttatgggatctctggggtgttgatttttctggctagaaacctctgtggcctgagtttctgtcctgcatccaggaagaatgaggtacacagacaagtgaagggtgaagaagatgaagagttttatttagtgttaaaacagctcagaggagacccacagtgggtagctcctctttgcaggcagatcatcccatggagtgttcagctctcagcagagaggaggccctggaggggttggctcctctctgcaggcaggtcatttggatgtctctgcaggtctctgaagctctcagcagagagggtcgtcttgtcttcccatcgtctctctgccctcttctcctctggccatcctctgccctgctctggctgaacccagctttcatggacctcagaggggaggaagtgggtgccaattggtccatgggcggccatgggtgccgtgaagaggcaccaccagtccccactccagtctgtgggactggcagcctggccttcagccttcaagccctctctggcctgcaagtggggccttgctggggacctgcccccttcaggccaggactctgtctgccactgccattcaaggcccggggggctcagccccaacaccactccaagataggagcaggcgccaggagtggagagaggccagtcagtgggaacagacaccctcgaacctgtagggatgcggaggaggtggggagtgtccttcctggggcctctgaatgtgcaggctgcagcgatgcagaggtccagcacctaggagggccaggcagtgggagcagacaccccccaatctgcagggattggggcggggagtttccttcctggggccccccgagggtacaggctgcagagacgccgggtcctgtgcctaggagggtggctgtagtctcagcagatcctgcctgcacccagccctcctccaagagcataaggagcctcgaattcacagctgcagtttgggtggctgtagccccgcccaggagtcgtgggactcctgcctgctccacagagcaggaggcctgggtctgcagctgtggtttgggaggctgcggcagctctgggagttcccatcccaactcagaaagggcagagctcccgatggggctctgactggctccacggagtgtgcagccccagccgtgcctccctgctgcagtcggcgtgatggcagcatttaagtacaagccataagaatcgttataaatgaccaataaaataactggggtgataatttaaatatatatgttgcctggtttctgaggggataaaaaccaacttacattttctcatcagcttcatatccctcatattgtcttaattttagttttgtttcttaattaccttattttattttattttacttttttttgagagctggtcttggtttgttacccaggatggagtgcagtggcatgatctcatctcactgcaggctgcatctgttgggctcaagcgatcctcccacctcggcctcctgagtagctaggactacaggtgggcaccaccacgcccagctaatttttgtattttttgtagagacaaggtcttcctatgttgcccaggctggtcttgaactcctgggcccaagcaattcactcacctcagcctcccaaagtgctgggattgcaggcatgggccactgaggctggccttaattgccttattaatacagattcacggcatgaaaggaagggcgcaatggtaaaacctaccaaagaaattgaagctgtgtaactagatacatcagctctgaaaaatcaacaaattattctctaggactgtagtcctttatttcaaaaaggattctcaaatgcatatgttagtggaattggcaaatttactaaaatttccatttgctttgaatttttatgtggtgcacacattcactctaggaggtgctgcctgtctctgggagagaatcaaagagagaagaggaagctttaggacctgacccccggggcccgggaggctggacctcacactgtcagtgccttcttcctccagagaggtacagtcatggaggtcagcaggcctgcaagacaagatctggacagtttgaatttttttggcggtggtggtggggggacggagtttcgctcttgtcgcccaggctggagtgcagtggtgtgatcttggctcaccgcaacctctgcctcccaggttcaagtgattctcctgcctggagacagggtagaatcccagactggtctcaaactctttgcctcaagggatcctcccacctgggcctttaagttgtcttttcatctacattttcaaaaaaatctatcacgtagtttttaatttgcattatttaatttatttatttagagacgtggtttcgctctgtcacccaggctggatggagtgcagtggtgcacagctcactgctgccttgaccccctgggctcaagccaccctcccaccttggcctcttgagtagctgggaccataggcacacgccaccacgcccggctaatttcccctgcttctttcttaatatggaggtactgactcagtgtttacatttgaggctttcttctgattccccctgcccgagggctttgtctcacagtgctcttgccaactgcttccccgcaggccctccccagcagcagtgccagggctgaggacaaagtgcaccaggcaagcttctgtttggtgctgaaatgtgtgggaatgactatgggaaggttagagagtggtcagtggtgtcgcatttctgcacgagtacagatccaggatagagaaacatatttccatttctcagtaaattcttagaaatcaggaatacttcaaggaactatttttaatttttttggtcttttaagcaaatcattgatatgtgtgcaacatggatgactcttaaaacattatgtggagcgaaagaagccagtccgaatagaagtgtagtgactggcccaagtctgggtgacttcaaagcctgtgttctttcaaccactccccaacggccccccagctccctgaatcccaggcctctccccttggtttctagtctgagccccaggtcggctgttaggggaggcccttggacaagtcccttcccataatgagaggcttagatgagattgcttctaagatttgttatagttctaacatcctagcaccttccaagtctatttcttttaaaaaattgacttgtttttggccgggtgcaatggctcacacctgtcatcccagcactttggaagctgaggcgggcggatcacaaggtcaggagtttgagaccagcctgaccaacatggtgaaaccctgtctctactaaaaatacaaaaattagctgggtgtggtggcacttgcctgtaatcccagctactcaggctgaggcaggagaatcgcttgaacccgggaggcagaggttgtagtgagccgagatggcgccactgcactccagcctaggcgacagagtgagactccacctcaaaaaaaaaaaaaaattaatttactttttgaatagttaatagtcacatgatacaaagctcaaaaggatatatatgtcagagaccaggaaactaaagagacaggaggactaagtgaaatatggtttcctggaatggatcctggaacagaaaaaggatattctttaaaaactagtgaaagtggcccagcactgtggctcacacctgtaatcccagcactttgggaggccaagatgagtggatcacttgagcccaggagttggagaccagcatgggcaacacagtgagacccgcacccccatctctaaaaaaatttgaaaaataattttaaaaaaaattagtgaaagtcaaagtttggaatttggttagtaacaatgtaccaatgctagtttctttctttctttctttttttttttgagacggagtctcactctgttgcccaggctggagtccagtggcacaatctcggctcactacaacctctgcctcctgggttcaagcgattctctggcctcagcctcctgagtagctgggattacaggtgtgtaccaccatgctcggctaatttttgtgtttttggtagagatggggttttactatgttgaccaagctggtctcgaactcatggtctcaagtgatcgcccaccttggcctcccaaagtgttgggattacaggtgtgagccaccacacctggcccagtgctaggttcttagttttgacaaatatgccatggtcctgtaagatgtcagcatgaaggggtatataactctttgtactcttacaacttttctgtaaatctaaaattattccaaaataggccaggcacagtggcttatgcctataatcccagtactttgggaggccaaggtgggtggatcacctgaggtcatgagtttgagaccagcctggttaagatggtgaaaccccgtctctactaaaaatacaaaaattaaccaggcgtggtggcaggtgcctgtaatcccagctacttgggaggctgaggcatgagaatcactcgaacctgggatgtggaggttgcagtgagctgagattgtgctactgcactccagcctgggcgacaagagcaagactctgtctcaaagaaaaaaaaattattccaaaataaaaagggtttttgtgttttttgtttttaaagtaatgttttccttttgcccgagtcattgagccacccagtccccaagccagacaaccaacgttcaatgttatctgtttcttatataatctttcagatatattcaattaatattcaaagaaaatgtatattctacaaatatatctccaaatagaaagtgtgtctctgagataaattcctagaagtgggattcctgggcatatagttttcatagttattgccaaattgccttccatagaagttgtaccaatttatcctcccaccagacaatgtgtgtgaggacctgttgtatcatcaacacagactgtggtctgagagtgaactggtattcacttacctcagtttaagtcagactgtcaactctcaaagtgctcttgaaaaaaacttctctagaaagctgctacaaaatggcggctccattctcgagggagtagaggcaagcagggagctggctgcagtggcaaagggcagcaaggccatgaagaagcgcttgccaaatgattaacattcctgtcgccaattactactgtcctcaagaggagaagacattcacagaagggcattgtctctgctccacagcacacaaagggtcaagcctcacagatttgctcctagttgggggaaaaaccctcacaggtcaaagtgttcagattacagattcaggaaaatccctttgcagaaagaagacagcaaatccccagtgaagttgaaaggacaaaactttcttcacctcagagactctccaatgaataaaccggttaaacatggtttggatttagtgaacatgaaaacaactggattaaagtataatctagctagaaaggaaaggacatgtgctgagacaactagctaagtaatgacaaagctgcagtgtttacatctgtcaagcaggaacggccattccagctttataactgaattctcttaaatgtttaatttttctttagctcaacgtgagcctctgctcgtgttggcctctttgataacactggcaccaaggcaactgtgtgagcacgacgggtgtagagtccaggagtctgcaggcagcagctgtcagggcgagtgttcggcatgggccttggccaagctgcacacggtccagcttggaggcagcatccatcgcacaggtgcaggttttagaatcacaaagacttgggtttaaatcccaattgtactttttactggctgtgtgaccttggacaaattaaactctgtcccatttcctctcttggtaaaatgaagataatacccatccaatagggttgttttgagaattaaatgaggtaatacatgtaaaagcctacaccgaaacctaaacactcaataggtggtcggatcaccaatctctttctgtctctcctgctcctgctcccccttgcacacacacctgaccaccaagtgaacctgttccacgtcagactaactccaggcacttcagatcttactctgtgacaggagcattcagagtttttacattagggcttcttaaacgtgtttgtaaagatccctactcaaatatctgtttgtaaaagtataaaataaaatacatgggattataaaagaaaccaacttattgaagtatgtttattaaaatatttttaaaacttgtgataaaatatgtgcttctttggaaaatgttaaacaagctgggtgcggtggctcacgcctgtaatcccagcactttgggtggccgaggagggcggatcacttgaggccaggagtttgggacccgcctggccaacatggtgaaaccctgactctactgaaaaacaaaacaaaacaaaaaattaggcatgtgtgtgcctgtagttccagctacttgggaggctgaggctggagaatcgcttgaacccgggaggcggaggctgcagtgagccgagattgcaccactgcactctagcctgggtgacagagtgagaccctgtctgaaaaaaaaaaaaaaaaaaaaaaattaaacaagatcagggagtgagtctgataactacaataattttcaagcagtgatcagtgtattccaagatttgcaacaacaaatgtgatataattaatatacttgcattttctaattggtgacagtcaaaagtcctgcttctactaatactctggtttacttccacattcataatggaagaaataattaatttcagttacagaatattaaatatgaccccctaactctcttccttagagcagaagaaaaaaatattaaagatacaccgttttcccattcaaattagactccaggtattataaaatattaccacctctgttctcaagactagtgataaaagatacttacaaactgtcaagccagcagtcccttattttacttttttctctgacttctttcaagattttatcttggtctttggttttttgcagtttgaacgtgacatacatgacatccctaggtgtttttgttattttttttttttttaccaacaaggttattctttttaaatttattccgcttggtgttctctcagcatcctggatctgtggtttggttcaccaattttggaaaggtctcagccattattacttcaaacatgtagacagtttgaacaatacaggtttgaactgcgcaggcccactcatacgtagcctttttcaataaaagtaacagaatgtgcctgtccctcctgcctccccttccacctcctccacctctctgcctccccacccctgagacagcaagaccaacccctcctcttcctcctcttcctcctcctcagcctactcaacatgaagatgaggatgaagacctttacggtgatccacttccacttaatgaatagtgaatatgttttctcttccttatgattttcttagtaacattttctttagcttactttaagaatacagtacacaatacatgtaacatacaaaatatgtgttaagtatattatcagtaaggcttctggaaaactaggctattaaattttgggggagtcaaaagttatatgcaaattttcaactatatgcagggttggcacacctaacccctgcattgttcaactgtatatatttttttgctctactctctttcaggtattccaattacacatttgctataccttttgaaatgatcccagtttttggatggtctgggtttttatcctactctttctcttcccatttcagtttgggaagttcttattgacctaccttcaaattcactaattgtttcctaaatttgtcaagtctatttatgagtccatcaaaaacatttttcatttttattatagtgattttgatttttagcatttccttttgagtttccatctctctgattacccatctattcttgcacgtctactttttccattacaacttttaatatgttaggttataattatcaaacagggaatctgtgtcatatccaactctggttctgattgctttctcttttcaaactgtttttacttgctttttggcatggcatgccttcaaattttttgttgaaagccaggtatgttgcactgggtaatagaaactgaggtagacaggccttaagtgtgaaggttcatggtaatcttgctggaggacggactatgtttaatgtttgctgtagttacaggtgccagaggcttcaccttcctctagtgtctttgcttttgcctgtctcttaactttgggtttccctaattactcctccacaaagggggacttccagctgtaatccactacgattacactcgaatcccactggtgcggtggtaaagtgtgggaagtgggatattctataatcttcagattaaatctgtgtcttagtgggcctgtgagcttcacaagtgtttttccagtggtagagcgtttcctttctggccccctactcccttccctggctgcagcatttccagtctatttccttgaaatcctgacccctcttgactaagttcccatccctgccccatgtaagtaagacaggaagcctagaggggggctagagtgggaagaacgcccttcccccaactgggataggctctgggagtctttcaccctggagagtaagccttcgtaataaaggttttggacattatttcataatgattattaatcccttttccacgtcagagccacacatcttactagatcttcactgaaaatgtggtgggattcttggaggtgaagcccacgaacttgtggagacccctcttaacactgtgatccccagggacttctcactctcacgctcacccacactcagccgctagcaattcattgccatctaagtgtttctaactagcttatggctccagtagcttttgctccagataagcagattttggctgtctctctttagatagccctgtttctccagattttagggtggtggtttgcccttcaacctcaattctctgatgggtccaagaaaagtcattgattttgcatttgtacagatttttcttgttgaaaggacaaagtgataactttttctcttgagacagggtctcactctgtcacccaggctggagtgcagcagcgcaatcatggctcactgcagccccaccctcccaggctcaggggatcccccacctcagtctcccaagtagttgggactgcaggtgtgtaccaccatccctggctaatttttttatttttatagagactgggttttgccatgttgtccaggctggtcttgaactcctgggctcaagtaatctgcctgcctcggcctcccaaagtgctgtgattacaggtgcacaccactgtgccaggcttggtgccaactttcaagctttttacctgtagaagcttaaaccagaattatttcattctggccattcccttccatccacctgaactgctgtgtcccttcttgtcctcacatttgcgatgactactgtccctcttagtgagtcttttcatgactggtgttcgatctctcctgtctgttagcactttgcacaatcaagtgcttggtgttgctagttgagtccactgggtcgctttcatttctggcactcactctacagtaaagagcatctgggatgaggtgttgttgcccagcatcctctaagcttcctttgtgcttttaaattaatttccctggcctccaaatcagtcttattttcttagcaaggttggaataaagcaaacttcactttctgtaaatcaggatttacaaaagtaatttctcaagatctggtaagtccttttttctcaatttcttgatttctttttgtaatgacttaagtagccaggtaagatcggatttggccaagttcaaggaaatcatagggcctcctatctaaatgactaaacctgacagttttggaattacttgggaaactttaaaaaagaaaatcctaaatgcagtcctaagagagtaattgtggtgggcagctatgtttaggaaaatacgatacttctagtaagctgtgcatgtccaaaagagctacttacacctaaacttaaaatcaaaactaaaaaacatactagggagacaaagtgaaaatactattagaaaaaccaaaccaaacctatccattcgtaacaaaggacataggaattgtttaacattcaccctttcactcattcagtaactgtattgaaagtcataggcacggctgggcgcggtggctcacgcctgtaatcctagcactttgggagactgaggcgggtggatcacttgaggtcaggagttcgagacgagcctgaccaacatggtaaaaccccgtctctactaaaaaaatacaaaattagctgggcatggtggcgcatgcctgtaatcccagctacctcaggaggctgaggcagaagaattgcttgaactcaggaggcggaggttgcagtgagccaagatcacgccactgcactccagcctggggaacagagtgacactccatctcaaaaaaaaaaaaaaaaaaaaaaaaaaagtcataggccctgtccacaagaaggaagtacaccaagccatggcctttagaatcaaacgtcttcacagtttaaatgcagtaccatcctctcctggttaaccttgaaaattctgctcaagctttcaaaacctcagtcttctcatttgtaaaaataacattatctacttcatagggaagttctgtgacagagatcacagtggaattattacaaacttattctctctatcccaaaacagttttaactcctttcctagcctaaacactggcatattgttagtaatagcagctggcacccactgagtattaatctatatgcgagggagtgggctaaactctgtccatccatacctcaaacacattttatctgtaaaggccttagaggccacagccttattctttcattggccatattcgccccactcatgtaaccaaaaaaggcaaagcaagcagaggcaacaggacggaattttaatctaggatggcctcctagcaaagagggctgagtggaaaaaccatgggatgtataaaaaggagatgctcctcctcccctaacaccccttccccaaagtcataatcactaccaggggtcatgatgttagaacctctgggtaggaaaccaaataccagataaacctattctggaactgccatggcaaatgagtaagagtggtaccatttgctactactactattatgactaccactgccaactgataactattattatgcttttatatgttccgacactgtcctatgaattttacatgtaatcctcgatgtaagttataaagttaccactgatattgaccctttataactggcaggagttgagacaaggcaattaaatacttgaatagtggacacagagcctgagattccttagaattatccatctattgctttgtaactcactgccaaattaatttttttttaggaagattcttaagggattctggaaccccctcctatgtagttagaattaagagcacctgcatttttacttcagcgggttaaaggcatagtttcactataaaccatggtctcaatttcctacaagataacactgaaaagcaccttcctccattaggcaaaaacacgttacctggaataaacttttcacctactttaaaacccttgacttttcaagagcatgcctgcccttaggaaattgtggtagaggttaaaagcgggcaggctagtacaagccatcctaaaccacgctattccttgtctgtaaatgatcaaaatcaagactccacggtgagtggaaaccttgacactactaacatttttctgctgtgggaggctggcttgttcattttaagaggtttagcagcatctctgacatccacctgttagagtccagtaacattccctagttgagacaaccaaaaatatcttcagacattgccaaacgtcccctgggggacaaaatcatccctggttgagaaccactgctttattttaatgtttaacagaaaaaaaaattttcttttgagactgggtctctcactcttgcctaggctagaattaagtggcatgatcttggctcactgcaacctcaacttcctgggctcaagatacacttccacctagccacccaagtagctgggactacaggcacacaccaccatgcccagctaatttttaaactttttgtagagacatagtctcactatgttacccaggttggtctcagaactccgggcctcaagcaatccccctgccttggcctcccaaagtgctggcactacaggtgagagccactgtgccttgccgagaaccactgctttaaagaattatttggttttgcagagctaccattattctgttctgcatacccaaaactgacagcctctgactttacttctctagttcactgaaataaaatttacatgttgtttagctttgtaccttcttacagtaattgaaacatccagtattagggaactgtgaaatactgtttgagcaacaaaaggccttatggggcaactctgacttcttcctatgacttctatgtgcttggtggacatcctagtttggccaagacccaagcttgtttccttttaaatggactgatccatcttcagaggagacgcatctgctgtaggaggacaaaatttctttactttgggatttaactccaagtcacaatgggtccccaaaccaccgcaagttgtacaaactagagaccacattctggctgaaaggtctgaacacaacacaagttaggcagcaagaagtcatgtgttttctggtatcttatcatttttgcaggtcaggctagaagactgtgcccttctcttaaagaggataaagtgtgctactatcccaaaccaaattaaagagaaagcacaaacctgctgactaagaagagttattacacccttgctaagtttgtttaaacaagtcactcagttgactaggaaaaaacttctgaaaaataggagaaatggtattttatctttgaaagtccttttaataaatgagattataaagcagttttcaaatacacaaagtgcttcaaaatgattcaataagccttaagcaatacattttttagtatatcacttttgttgttgttaaaaataccccattcaatggatggaagtatatttgatatcaccactgtttaaagggaatggagttacaggaatgagaagtatataattagtaaataatccctctcaacaagtgacttaagtagtcactcatagagagcaaaaaaagctggaggcaacacaatcagtgcatatcagaaatgcattttaatttttatttgaaaacaacttaaatttttagacaaatgattttagtatataaatttgcttttgtttttatacagaatataaagatttccctcattaatcttccatgtgaagggtattacaagcctggaggaagatactttctgcacacaagtatgtatcttatgtgtgcagtattggaaaccaatggtgtagtgctcctacacataaatggggtcaagtgacatcacaaattaaaagggggaaagagaaatattctagttaatcagatgcaagaagcaaacaagacgcaaaaactgtgcaaataagaccaagccagtaactttagttacgacactgcagattacactggaataacaggtttgtgaggctatagtgtgcaccacattaaaacagcaagaaagagctatttatatagaaaggctggaatgagggatttttactaaagcaaattaacttcttgtcaactgccaaaacaaaacaaaactgagcatatgagtgttagtatactgaaggcatgttataccagtttctgtgcagcatgctaaaagttagaacttcttcactggtgcttatcaatcattaatagtcacgtttttgccccttcttgccaaatttcaggcatgtcttattttagatggagtatagcttttatctattatttcatcttgtaaaaacatgtgaagacaacgttcgttctgtgccagaggatgaccagcgaccctgagaataaaaaatataaatttagtccaatattttatacaaggtgggggagttcaaaacacatattttaaagttgagaagcatgtataatttttttttttttgagatggagtcttgctctgttgcacaggctggagtgcagtggctgatcttggctcatggcaacctccgtctcctgggttcaagtgatttcgtgcctcagccccctgagtagctgggactacaggcgtgtgccatcatgcccagctaatttttatatttttactagagacggggtttcaccatgttggccaggctagtctcaaatccctgacctcaagtgatctgctcacctcagcctcccaaagtgctgggattacaggcgtgagccactgcgcccggctcagaatcatgtacagtttaccaataagtattattctggactgtccataaagctatgcactatcaactaatggtatatgttcttttgtttggttcacaactctaattaagaaaacattaatcacaaatttttcactgcttgtggcacatgtacccaattagctttacatcatagctggtgtattcataagaaacttaaattaattttaatgttaaaagtgaagcatgtcaattgatcctaagaatcttttttttttttttttttttttgagacaaaagtgttgctctatcacccaggctagagtgcagtggtgtgatcttggctcactgcaacctctgtctcccaggttcaagcgattctcctgccacagcctcctgagtagctgggactacaggtaaacaccaccacgccccactaatttttgtatttttagtagagacagggtttcgccatgttggccaggctggccttggaactcctgacctcaagtgatctgcccacctcggcctcccaaaatattgggattacagacatgatccactgtaccaggccagagtctattttaaagaggagaagatacaggattgaagttagaaatacaatgaagttcaataaaagcccaaaatactaaaaaaacaggcacaaatatccaggtattttgtttgtttttgcctgcttaaaaccacactgggcaaccggactattatttcagaatttaaaaatatctaatataggccaggcgtggtggctcatgcttgtaatcccagcactttgggagaccaaggcaggcagatcacttgaggtcaggagtttgagaccagcctggccaacatggcgaaaccctgtctctactaaaaatacaaaaataagccagacacgatggtgcgcaactataatcccaactactcaggtggctgaggcatgagaatcacttgaacctgggaggtggaggtttcactgagccgagactgcaccactgcactccagcctgggcgacagagcaagactgtctcaaaaaaaaaaaaaaaaaaatctaatatagtactgccttctccaaaaggaaaacagattcacagacaatgaatattgagtgctacagtagataaccaagggctttatgtaaccctttctctcctgtttaccactcatggatcttcaaatcactagataaaatttacagtgtaagctcacattaccatattctgtacgatttgatttacttttgctagtttaaggccaatgcacaattacagtgaggtctttcttggcataaatctttctaacactctggctttctattattttacaaaatagctatatttcaaatgggaataaaattaaaagctaaaaatattggtttgagcttatcaagagtttctaaagtaaaaaagaaacaatcctaagtcttcttacattttcaaaagaatacattttaccatgaaaattaaaaacatgcacctttatacaagacatgctaatacctccatctgcaatcaaacaagatgattgcaagtacattgtaagttttattgttcatgctagaacataccttaaatcagaaagaatcataagtaaaactgtattttttaaatgccgtaattttaaatgtaatttgcataaattaaccaagaaaaacaaatacaaaacgtaggtcaacacaaagatgctcatttcaatcactcaaatgtgttaatatttatcacatgatattcaacttgtcagatacttttactttgtttaaatgatatgaaaagttaggaaatggctgaaagaaaaggcaacagtgcagtttagcttaacatctaaactacaagtagtcacttaaagtagtcctacactttgaggaataggaagcacttacttgtttataaactgctccagcccttgttttctttcctcaataaaattgtcatcaaatattccatcatctcctctaaaaggaagctgacgcaaaaacgctttcccagggagcgggggaactacgacctaaaatgtgaagacagaaactccttgatcatgatgactgggttgtgaaaatttatagagcacaacatgaagacaaagcatgtcctcactatgacagccatcgtccggtcaaactagttgaaatataaaagagcaaaaaatacactgaaaaaagaccaaatgtttagacaaatgcagaatagcccatcagacaaaagctcctaattcaaaggcagggcccatagcttatatcatttttcttggccttatcaaagcccaggtatacaaagagaacactcacaacactgaaataaaggttaccatgcccctcagacacttgtgatgccacttggagaaggcaatgccttattgcaatggaaactgcagagatcaaaatcaactctcaattaaatgaagaaacgttaatgttctctctgcaacatggttaggtaagaattctggtttcagccgggcgtggtggctcatgcctgtaatcccagcactttgggaggccgaggcgggcagatcacagggtcaggagatcgagaccatcctggctaacacggtgaaaccctgtctctactaaaaaatacaaaaaatgagccgggcgtggtggcgggcgcctgtaggcccaactactctggaggctgaggcaggagaatggcatgaacccgggaggcagagcttgcagtgagtggagatcacgccactgcactccagctgggctacagagtgagactccgtctagaaaaaaaaaaaaaaaaagatttctggtttcttcaacctcttaccatctgcatacagtctttcctacttgtgtttgaggtgatgacaaaataccaataactctagttgtcactattctgtttcctaaattaagaaacaagtcaactttctcccaaatgccctatcctgctgtcttttcccaaagacctgtcatttctcccttctcgcactataggaagatcccaaattttccccttcaaagcctaaccaagggtcaactcctgctgatctctcccttctgggaattatctggagctcaaatattattctgggccaggtgcagtggctcacatctgcaatccctgcactttgggaggccaaggcaggcgggaggattgcttgaggccaggaatttgacacaagcctgggcacatgtctacaaaaataaaaaaaacttagctgggtgtggtggtgtgagcctgtagtcccagctacttaggaggcggaagtgggatgatcacttgagtccaggagttcaggactggagtgaactaaaatgtcgctgcactccagcctaggtgacagcgagaccccgtcttaaaaaaaaaataaatttttaaaaatgttattctggagctcaaaatacttgttttgattaaatagcacctagctatttcacaggttagtttggtttctctaccctagcactactgagaatcagataagttttgtactggggggctttcttgtgcattcttttctttcttgagatggggtcttgctctgtcacccaggctggagttccgtggtgcgatcatggctcgctgcagcctcccccagactcagatgatcctcctgcatcagcctcccaaatagccgggacactacaggtacatagcgtgctaccacgcctggctaatttttctattttttgtggagatggtgtttcactgtgttggccaggctggcattcttttctttagcagcatccctagcctctgcccactagacaacatagcacccccagctgagacaataaaaaatgtctctagacagtgtcaaacgtctcctgggggataaaactgcctttggtggaaaaccatcaatctatcatactaatgtcttcaaatcaagacccctgtcttaggcttcttgtggttattttaagaaaaactgggcatacaacagaagctcaaatatctgttaaatgaccaaccacttagctggatccttactttaaacgcaaacagagaaatgtgtaagcaaacaatcagaacaaggagaaatatatatagtaaactgatacatatttttcttttcaccaataatacaaattacacatattcaaaaaaattaaaactttaaacccttgatatagtttctacaacgagttgtttatcctcaaacaaaattcaatagggtaaaaaagggaaagagcaactcgacttcatatagattaacaaaaaacaaaataaaaacaaaaaaaccaaatgtccaaataaactttataatcccttcctagatttactctcctcagatgaccaatgatgaagatatctatggatttgtctccgtaaatttatgctagcattctcagatctcacccccatgttaacatctgtttagttgagagttaaaatctgcagggaccttctataactgagaaacaaaggaatgctaaccattacgttccagtagaatggctatctggtgggcagggaaaaatatctgtatctacacaattattatttaaaaaaagaattctggaaccactgtgttaaataaatgaccaccattaattcagggtagaatttagcatgaaacttaagaaaaggatagctcaaggatgtcagttaaagaaagaaggaaaatgataaaaaatgtaacaatatatatataattaaatatatataaatttcatatataatgggaatttaagaaaaggatagctatgcattatcctctgtagagatacactcttcctaacatattcaaactagtcattcaaatggatggggaggtggtaggcaacaggattaatgatctataaaaatcataaatggctcatccagctaagattctcttctacatcaaattatttttgctgaagcagtctgaaaacacctaactggaattctaacaccaggttgggtgcggtagctcacatatgtaatcccagcacttcaggaggccaaggtgggtggatcacctgaggtcagaagttcaagaccagcctggccaacatggtgaaaccctgtgtctactaaaaatacaaaaaattagccgggcatggtggtgcatgcttgtaacccctttactcaggaggctgaggagaattgcttgagcctgggaggcagagattgcagtaagccgggactgcaccacggtactccagcctgggcgagagctagacaccgtctcaaaaaaaaaaaaaaaaaattctaatactaattaaaaagtcatgaatgcaaagatatgtgcgtgcatgtggggtgagaaataggagaatatctggtgagcacaatatattgaaagctaaagcaaactagaataaaagctaaaagatctgaccataatacatgtcagctaatttctagcttagtttaacagatcttagttaaaagtactaatataccacaaaataacttgattacattgttctttgcaatactgtaatacgagtaaaactttcacatggatttaactctcaatatatttaactggtctaatgttaaatgtgaagtattgtgcttcaaaggacaacatcaagaaagtgaaaaacaacccagagactgggagatatgtgcaaattatgtatctgatagggaactctaagagtcttatatattctcgacataactctataataaaaagatgaacccattgaaaaaggcaaaagctctcaataaagatgtctccaaagaagatacataaatgaccagtaagtatatgaaaagaaaatcaacattagtggccattagagaaataaaaatcaaaaccacaatgcaataccccttcacaaacagtaggatagctataataaagaagacaggcaattggtaaggatgtggagaaaagtagaacctcacattgctggtaagaatgtaaaattacacagctgctttggaaaaacggtctgccaattcctcaaaaggttaaaaagagttatgacccagcaatgtactggtaggtatatactgaaaagaaatgaaaacacatgcagacagaaacctatgcacaaatgttcacagcagcactaccaataacagccaaaaagtagaacaaaatgtccaccaaataagtgtataaataagatgtggtataagcatacaataggatattatttaggaataaaaagaaatgaagtaattgatgcatgttagaaaagcatgaactgtgaaaacatgttaagtgaaagaagccagacacaaaagatcacatattgtgggcttccatttacatatgcccagaatgggcaaatccacagagaaaggagactagcaggtggttgccataggctgagtgaggaagggttggggagaaatcagtggtgtctactaatggggacagggtttcttttattgggtgataaaaatgctctaaaattgactagtgctctaaaatagtgatggttgcacaactctgtgaacatattaaaaaccagtgaattatacactttaaatgggtgaattgcatggtatgtgaattatatctcaataaagctgttactaaaaacaaaagcggtcgggcggggtggctcacgcctgtaatcccagcacttcgggaggccaaggcgggcggatc

SEQ ID NO: 645 - DNA, 1799 bp, Homo sapiens
acactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaaa

SEQ ID NO: 646 - DNA, 3491 bp, Homo sapiens
gggggtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagacgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgagtgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtaaattttactttgttgcagatagtcttgccgcatctgggcaagttgcaaaaatggtggagttaaaaaaaaaaaaaa

SEQ ID NO: 647 - DNA, 3160 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaaaaaaaaaaaa

SEQ ID NO: 648 - DNA, 977 bp, Homo sapiens
gcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataaaaaaaaaaaaaaaaaaa

SEQ ID NO: 649 - DNA, 1505 bp, Homo sapiens
tattaaagttcatctgtgtgtgacagaagagattttacccacagtgtggggagtttctatttttctagcctgtgaaatggggttggttgtcctgaggtgcagagaccagaatgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaa

SEQ ID NO: 650 - DNA, 2375 bp, Homo sapiens
gggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaacccaaaaaaaaaaaaaaaaaaaaaaaaaa

SEQ ID NO: 651 - DNA, 2982 bp, Homo sapiens
gccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgt

SEQ ID NO: 652 - DNA, 2290 bp, Homo sapiens
agaacatagggtactccgagtgaagaattcagcagctaagtggaagttgtcttctattccactttaaatacttttatctactgaatcgcaagaaaattgggtttctggtgctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgccaaaaaaaaaaaaaaaa

SEQ ID NO: 653 - DNA, 4629 bp, Homo sapiens
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 654 - DNA, 5898 bp, Homo sapiens
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttaaaaaaaaaaaaaaaaaa

SEQ ID NO: 655 - DNA, 1012 bp, Homo sapiens
aggcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatcaaaaaaaaaaaaaaaaaa

SEQ ID NO: 656 - DNA, 1075 bp, Homo sapiens
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 657 - DNA, 793 bp, Homo sapiens
tgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcagtaaaaaaaaaa

SEQ ID NO: 658 - DNA, 714 bp, Homo sapiens
  misc_feature (609)..(609): n is a, c, g, or t
  misc_feature (699)..(699): n is a, c, g, or t
aatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataaaaaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttctttctgttgctgccntaaaaatagaataatgactattctgatggatagagacatagcttttaagctggtggtgtggtaaatcccatgggatggtgcagactttcngagagtattgggggg

SEQ ID NO: 659 - DNA, 733 bp, Homo sapiens
ggcgggagcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgtaaaaaaaaaaaa

SEQ ID NO: 660 - DNA, 1682 bp, Homo sapiens
gaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactgaaaaaaaaaaa

SEQ ID NO: 661 - DNA, 3982 bp, Homo sapiens
cgcggcggcggcagcggcggcggctacaccgggcttggccccctccctcctccgttcccccctcctcccccctcccctcagcggtggctcccaagaagtccgagacacgcggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgaaaaaaaaaaaaaaaaaa

SEQ ID NO: 662 - DNA, 1139 bp, Homo sapiens
  misc_feature (92)..(92): n is a, c, g, or t
aggtatctggcacaattaaccaaatgtctgcccatttttgtgtagctttcatacagtacagatttcattgatgtcgctcccacatctgagtnttaaaaacatttgacattgttcttctcagtcctcacaacacccctgtgaggtaggtggtattgaccccattccacagatggggaggtctaggcacggaaaggtttagtggctcctcacaggccgcgtggtggggcagcagagtggtgctctggccccgcgccgacgccgccttcacattcacacttcttcagtgccaccgcaacactgcatggcaggatctcacgctgaggccaagttcctgtctagtccagaatgaagccagcgtctcacctcttaaagcttcgatgtgtgactcaaagccaacttactctcccaaacttgcaaaacaaacatactgactgaatcttagttgggactatttgcagtatttaagattatttttgagagtcaatctgcttggatttgtagttgtatatgctcaaatccctttggaaaacagtttgaaatgacatgagggacaatcgtaattttgagaacagaacacagaaaacaagagttctgagactggcattgaaattgagaatataagctatggtaaaatgagaatcaaatcccaaataaacggagagcagcacttctcaatgtttaaggccacgcacagggcaggcattcagtaagcacttcttggatcaaaagaaactgatgctcctttgagccgcctatcactgacaacaggagctgagacccccgggaaagccagccagggccatgatccccttggcctggggccacggtcacacaaagccactcagccaaatcgtgtagagttatctaggcttacttgctgcaggataaaagttgaactagaacaccaagcattgagctaggaatacccctttgaatgtgtactgctacttataaaaaataggtatgtagctatgattaaatagatgaagggcaaagcatcctatgaggagttgttttaaaatgtatagatgtcatgcrtgggggacagaataaagagttaagcggttgtgttttcggttaatgaaggtgtaatgattttacgctgataraagggacctcyacccttctgcktgagtttt

SEQ ID NO: 663 - DNA, 1063 bp, Homo sapiens
gatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgaaaaaaaaaaaaaaaaaaa

SEQ ID NO: 664 - DNA, 423 bp, Homo sapiens
ccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaagatcttc

SEQ ID NO: 665 - DNA, 6928 bp, Homo sapiens
ttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtgattgcagtgatctctatctctccacttcttttgggaaagaggagcacaggagcggaggaaaaacttggccacagtcacacttggaaagatagtagattattttcgttctcctcagcaggtctgctgtattcctcgctcagcgctcaaagatgtgggtgatgtgtcaaggaggcatgcactcagctggtccttgctgagttatttgctgacacaggtctcactaaggtggctgaggggtgggagggagaaggctaatcttggaaccttcacaggattggccttgatccttgggtaacacaagagtgattcctgatttttagacacctaatatgtgcctagtgcttttctctttgttcctcactatcctgcaaggtaggtattctcacttacagatgaataaatgggctcagagagattaggtgattagtgacaatcagttgtaacttagcactgttaggctgcaaaccccttgctccttcctttccaccaaactatgttgattttccttccttacctccctccttgtaccacaggttctgtcctcaagatatcaccccactgggcagtatctgaaggcagacccagcccaagatggtgcagaatatacagctcagggtgaaagttcttctgggctcctgctaacaaagtcttggaaaaactgcctgggaagccatattatgaattagtgctagaagaagctgtggggggaactgagttctgtgtctaattgcattacttatgtgtccttgaataggacccataactcctcccggcatgcttttgcatctatagaactgaagctgtagttctagatggcactaagggtcttggttcatattcagctgctgcttccccccaaggaaaagatgaggtttttccccttcgattaccttttgagggatgtttaggctcaaattctgcttgccacagaggaaacatttctgctgtagttgtttacctccatcctagctggcagtgtgggacacacacatacagcaagtgaaggtgggggtttgggcctgtatagaggtcagctacgctgcaggctcatctattcacaccagcaggtacagagaaaactagtgttttgtaaagtcaaatatttgttgggggttggagttctggggttggaggaggggctgttctgggcatcagttgagcagatgcccaggatgcctgggggagaccagcttcccctacaaatcagagctctaaattacaaggtttttaccaacgtgaacagttgggggaagtcgtctgctctcatttgcgtaatggtttctgtcactggtgattagacacaggatgaaggaaaagaaatttgacaattaggaatgagcgatcattaatctgaatctgttaggagacagagaggggaaggatccttatcagtgggccagcccagtatggggagacactccctccctctgcccccagagactcctgggctacatcctctttcagtattgccacaagtgggcagagcttgtatttcttaacaaagattagggacccagttgccagcctgagatggatataggaacagacatctttgggcatgagccaacaaagatagaaatagatgagtgtcaggtacaagctataaggcaaagaataacagtggaaaagttttgacatgtgtttgccatttgtggaaaatgtttttgtaatagtcaacacccctcatagcccacctgtgacaagtacttgttacattccagcactgtagggcgtgaggaaaatctggtccttatcaaatcccaggagcttctgcttagttggggaagaaattacatgaagcaaccagaggttataaggccacacttgtatatcgtgcaccctgtgtggacaagattagggactgttgagagaggaggaaaccagtagagagcaaagctctacccaggctccttgtaagcctctgggctcccccgagagggcctcgctactctacgcttcctagcaacgttgatgtccccacaaccccacatcagtgcagctgtggctgtgtggaggggctctgaggcctctgaggccagatgtgtaaacagtgctgaggttcagtaataggatgagtcttcaggtgtggagcagcccaccttggctcttcccatgtctctgtgttacttctcatattctgctgtcctttcaaacttcaaggacagtattaatttatactagtatttcttcctcagttttgtgacttgaatgcagtgagtgccttagaggatccaaggatgaaggaatgcgggttggtggttctctctttcagaatgggaacttcccaaaaatggggctgcgtctcgcctctcagtaggttccctacctctgggtcttccacccttcaaaatctggtacagaatttagcaggggctgcagggaatgaccctcagggaccagtttcacccagatggggtagatgatgaggtatacctagaagtagctcagggctccagagtctggcctttcagctggtgtcttactcccctttgagaccttcagctgcttgtcttccactgcctgcatacttctctgatgtcttctcaaactgttggctctaaagggatgttccagcctccctctccagagctgcctgcagtttcccttattcagctgtctcctgcctagtctctccagcggcctccttaccaagaccctttttcctaaacagttgtccttccctcagaaactccatggctgcaagtgtgaatagacttgtctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttaaaaaaaaaaaaaaaaa

SEQ ID NO: 666 - DNA, 2769 bp, Homo sapiens
gcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggcccccaaaaaaaaaaaaaaaaaaaaaaa

SEQ ID NO: 667 - DNA, 1340 bp, Homo sapiens
gcactgtctctatgctccccagcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgtaaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagataaaaaaaaaaaaaaaaaaaaa

SEQ ID NO: 668 - DNA, 1428 bp, Homo sapiens
gggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggag

SEQ ID NO: 669 - DNA, 6824 bp, Homo sapiens
aaatgatcttgttctcttggaagactgagagctgtgtgaggttttctcagtcttgtcatagcctaggatggttagagtttcaatgttataaaaatggagacgaacactgttgttcggattccttttctggtctacaagtgtgaagggtttttaagcttaccagtagtgacactttaagctgcagcttggttttccctcctccctttttttttttcctttttcttttaatttaatgctgtagagggtgacttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaaaaa

SEQ ID NO: 670 - DNA, 1304 bp, Homo sapiens
gcacgagggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactcctttaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctgcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgaaaaaaaaaaaaaaaaaaaa

SEQ ID NO: 671 - DNA, 3004 bp, Homo sapiens
gttgtgactttccctttcgaattcctcggtatatcttggggactggaggacctgtctggttattatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgaagaatggtgcctgtggcatgatgccagctttgcaatcatgagattcaaaagccacactgtggaattgaggaggccctgcagcgacatggagggagctgctttgctgagagtctctgtcctctgcatctggatgagtgcacttttccttggtgtgagagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctaacacagtgaaaccccgtctctactaaaaatacaaaaaattagccgggcatggtgcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactca

SEQ ID NO: 672 - DNA, 583 bp, Homo sapiens
ttttttttttttttttttttttttggggctggaacttgctttatgtgtccagcatctccgtgagcatctggtgtctcagctcaagtcaaccctggccagactccaataacagacacaagaactgaaaagggggccctggttaccaaaaaccagaggaccctcattaacatccccaaatttcaagccagactgaaatctgtcagaagaaatgacggtcccagcctacccccgacacgggtggaacagagtaggctgggcccagctagagcctcggcctgggctgctgcacctgcggggcccacagactgaggaggcggtcggcctccctccatcccgacagcagagccccgtgcgtcgtggagtaaaacgtgcgatgtgtggcttcccccgcaaacaggatctggagctgggcgccggcgccgtctgcagggaggggctgagccagcaggtccaggtcgcccccagtactgcccacggccacgtagctgtaggaccccctagtgtacggggcgctgtgccagcgagaccgcaggacgctcttgggcgcggggagccgtgggtttcctgtcactctccggagcac

SEQ ID NO: 673 - DNA, 2643 bp, Homo sapiens
acgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggggaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggtttcctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctct

SEQ ID NO: 674 - DNA, 1369 bp, Homo sapiens
attaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaaaaaaaaaaaaaaaa

SEQ ID NO: 675 - DNA, 2694 bp, Homo sapiens
aatgaatgggggagccggaagcaggaagtgagtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccatcaaaaaaaaaa

SEQ ID NO: 676 - DNA, 483 bp, Homo sapiens
ttttttttttttttttaccttttcataatgcatcccccaagttgggggattaaatcgctgaaatgtttatttagccctaaaaaagtaaattcaaagttgcctgtgggtagacctacaataaaattggttgacaaagtttggtttataaaatatacttacatattgtttcttaggcaaaaatcggcagcaatctggaataattcaaattttttatgaaattaattgcccatctttttatctgtgacaataaatgccaaaaatgactcagagccaataaccttcatctgtcatatggaagaaacaatcctagggcaatagttttttcaaaagcggaactgacaaagataagcgtttaaaagggtcttgatcaattagttacaggaacatgaaagaaagtgttccacagagaactgtgtctcctaaaatctctttcttctatcatctaccttacccaaaatttctcaatccaaccacatctacctg

SEQ ID NO: 677 - DNA, 1809 bp, Homo sapiens
ccgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgcaaaaaaaaaaaaaaaaa

SEQ ID NO: 678 - DNA, 328 bp, Homo sapiens
tcactatgaaaatgctttaatggtggtgtctgtacagcatggatgtggacagggaaaacagcaagtgcacacagtgggacaggccacaggacaggctgggagtgaataaagagttcacactgcttccctgctttccccagtgactgaaggctctaggcctcggtgaactccatctcgtccatgccctcgcccgtgtaccagtgcaggaaggccttgcgccggaacatggccgtgaactgctcggagatgcgcttgaacagctcctggatggccgtgctgttgccaatgaaggtggcggacatttttagcccccgaggtgggatgtcac

SEQ ID NO: 679 - DNA, 1216 bp, Homo sapiens
cgcgcgcaggaaggccgcctcattggtccgcgctgtcgggcttcggcggcttttctctttagcgctcagggcgtgacccactgctcttcctcttaagaaagtgctccattccttccggcgcccggagctgctggcccaaaggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcaggagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagccagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatatagatttctcattgtttgggttggaatacaccattgtttatttttgttcctttgtcttctggcttttcagctgttctttgtagtcccttttattatgcataaaataaagaaattcttagatt

SEQ ID NO: 680 - DNA, 1160 bp, Homo sapiens
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 681 - DNA, 2711 bp, Homo sapiens
gggagagggagctctcgggtcggggctagggaaggctgaaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggtcaggagaacaggaacagaactgagcaggggcaggtctccaaggcaagcccagctggtgtgacttagacaatgacgaggcttcaactcactgtctttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaaatttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataaaaaaaaacg

SEQ ID NO: 682 - DNA, 2487 bp, Homo sapiens
gcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaactctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaaaaaaaaaaaaaaaaaaa

SEQ ID NO: 683 - DNA, 1462 bp, Homo sapiens
acggaaggaaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagatamccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttatttttgggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaa

SEQ ID NO: 684 - DNA, 609 bp, Homo sapiens
tttttttttaaagttaaaagtgaaatttattacaatacaataaatgcaagtgtcattattaaaaatgccggttaaaattataaagtatctaaataatttttctaatataaatattggaaatgacaactttaacaattctatatgtacacaggacactgaaaacataaaatcatgaacaaggccaaaaaataacgttgcacattaaccctttagttattacttttctattttccagtcccagcatcatacctgctaattactcagatcacaagcctcaaggattaagtgttttgaatgtatttcagtttcatactttaacaatgcttaaagactattggttgtattctgatcaaatggttctccttcccatatttccctttctcaatagatcttagacaaaaaggtgagcagggaaaactgtgattacaggatccaacatgacaggtatacccaatgattcatttaagggtggcataaagttatatagaaaagacctacaggacggaagacaagtacatcaacatgtagtgaaattaagcagttcacccactgcgtgcttacatggctcctatatctcttcgggaagaagccagagccgtagagaagtca

SEQ ID NO: 685 - DNA, 2088 bp, Homo sapiens
cgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccacagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaaggaaaaaaaaaaaaaaaaaaaaaaaa

SEQ ID NO: 686 - DNA, 808 bp, Homo sapiens
gttatcaaaggaacttttctttgtttaaatttgctgatgcaggaattaagtttaaacacaactctatagaaagaaaggagattattacccagaattcacatgtagtgattattaaggacaattttttttttaactaaaaaagttggcggcaggggtggggggtggcaatcatttttcttcctatacatacaaaggatatgtcaaaaatggcgtcttctcttgtggcctgttattctgattgctgctgtatacagtttgtcactctttagtttttagttaagcatactgatagactttcctctaaaagccattcactccagattttacctggggaatattctacatactgttactttctctataaaactcatcaataaatcatgaaaggcactgagtttgtaaatcaggaccctaaatgtttaattgtaaataagtttcagataattattatagctttgcgttgaagtttgtgttttttttctcaactagttaagtcaactgttctgaaatactctgtattgtagattatgcagatctttacaggcataaaatatttaaacctgtaatatgctaacttgaagaagattgcaaataaagctgcttccgtaaaaaaaaaaaaaaaaaaaaaacttttgggggcgctggcccggaaaaggttttaaaccttgcgttggggcggccccgtggtatgtaaccgcgccacgacggttccaggacccggccgaccggtggttccccaaaaaaaccgcggccccgttcgacacccggtcgcgcctgggtcacacagccggcaacacccccgcggggg

SEQ ID NO: 687 - DNA, 688 bp, Homo sapiens
agccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggtgggcacaactgtgtgctctgctttccagcatcttggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacctaaaaaaaaaaaaaaaaaaaaaaaaaaaaa

SEQ ID NO: 688 - DNA, 332 bp, Homo sapiens
tgtctttttattattctttattggtcctaccaatgtgactctttacccaggcccactgttcctatgcacactggctttgtaggcattcacatcatatgtctgtgtcctgaaaatctcaattaatttctccttcctattccttttccatgctctgcctcattttctcagaaattgaaggcatttgattattatttttttgtttgggtctgtgtaaaggttccttggcaggagaacatgcatatgactttaaaataaagaccaacattctgacactaaggtaatgcacagaaaaaatacagtactcagacatcattgcaaataaatcccataca

SEQ ID NO: 689 - DNA, 384 bp, Homo sapiens
  misc_feature (335)..(335): n is a, c, g, or t
tttttactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggtgtctanctggagcaggtcgctgaggtccaggagcatgtgcggcgtgccctcgtgc

SEQ ID NO: 690 - DNA, 2117 bp, Homo sapiens
ggcaacgaggggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccgcccgcccgcccgctcgcccgcccgcccgctcgcccgctcctgtggtttttctgagcgtgcgggctccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaaaaaaaaa

SEQ ID NO: 691 - DNA, 461 bp, Homo sapiens
tttttttcaaaagcaaatgcttctaaactttattcacactcgagttgcatctctgcgccaccactgccaatgttttgtcatgtcacgggcagtcaaccaggagcagggaaggagagaccaggctgatttctgccttgttgggaacactgtcatggtgcctgtagatagtcactgaagaaacataaaagatgaaaacccaggctatgctctcaacagggcagaagctcccccattaagcccaagtctaggcagctgcttctctccacagggatggacctggccttgctgggaggaacgcccacaccaggacctctggaagcagtcccaagggcttcagctcacattatgttctttccatttggtgataaattcctaacgccttaccccatttgctaactggaatgcagagagcaaatgccacggttgaaacgctctccttcgtgaatcagctccttccccag

SEQ ID NO: 692 - DNA, 2774 bp, Homo sapiens
tcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttaaaaa

SEQ ID NO: 693 - DNA, 4361 bp, Homo sapiens
cttccccgccccacggaaaggggaggagcttgggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatcaaaaaaaaaaaaaaaaaa

SEQ ID NO: 694 - DNA, 1817 bp, Homo sapiens
agcgccacgggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaaaaaaaaaaaaaaaaaaaa

SEQ ID NO: 695 - DNA, 716 bp, Homo sapiens
  misc_feature (461)..(461): n is a, c, g, or t
caagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgtttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaatngtttgaaccctggaggcagaggttgtagtgagtcgtgatcacacaactgcactccagcctgggcaacagaacaatactccattccctcccctctagcccacaaaaaaaaaaaaaaaaattcctgctttagatgagctctagggctgctgagtacagttgtccccagttgcacagggcccagggttgggcattggtaagaaggcccgtgcaatcctaaattgagtgtggttgtggggagttggttccccgattgta

SEQ ID NO: 696 - DNA, 2208 bp, Homo sapiens
ggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggtatgaatttctgaaaaaaaaaaaaaaaaaaaaaaa

SEQ ID NO: 697 - DNA, 5777 bp, Homo sapiens
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 698 - DNA, 444 bp, Homo sapiens
  misc_feature (307)..(307): n is a, c, g, or t
  misc_feature (320)..(320): n is a, c, g, or t
aagttgcaaatactagtctttttttttctccattgaaaagaccattaatttcttggaggtgaggtctcaggtaaggatggggcctagtaggcttaaggccacaggaagcaaatgacccccagtctacccttttgtctctgccatgcaggcccatcacactgggttggggaggtcctcaggaggctgtcacacatggccttaggtaatggcaagtccttcctattcagctctctgtccagcctccaattgaggaggcataacaagggaaaggtgagatggagggggtggggggtgggggcgggatcgnccaccaaatccancaaaaatgaccagctccaccttatctgctccaaagctatcactgtctccacaggtgtaaaggctcctcctcacatcgactgttgtgaatgagtgagcgacaggccttggccaagctgagacttg

SEQ ID NO: 699 - DNA, 1637 bp, Homo sapiens
  misc_feature (1315)..(1315): n is a, c, g, or t
  misc_feature (1498)..(1499): n is a, c, g, or t
cgggggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggcccgtggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggtcctgcctcgccatcggagctctcatgggccccaggaagtcagggacagctcccttatacctggcccacgtccttctcagcctgccctcgacaacagtgaccaacagacaggcagctgggtttccaggccatccctctgttgccatcagcttgattggcttccccgagggccagcagggctggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtngcacctgccaatagctttgtcaatcacagccccataggaacgtctggaattgcttgggagttggggagaactgtcaagaagagtgaagagagtgccaaagcggagatctgttcacctgggtggaggggaccactaagatcaagatcaaagattctccccatctcacagacaaggaaactgagnnagagggaggagagaattgctcatggctccagaactggtggcaagtttctctggactcttaggtttatttttaatatgaaatataaaaacagtttcaaatatcttattgagggagaagtaaaaacttatttaaaccccg

SEQ ID NO: 700 - DNA, 925 bp, Homo sapiens
ggtcaccaccatccctaccattgggttcaatgtggagacagtggagtataagaacatcagctttacagtgtgggatgtgggtggccaggacaagattcgacccctctggagacactacttccagaacacccaagggttgatattgtggtcgacagcaatgatcgggagcgagtaaatgaggcccggttaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagcgcctaacaaaagcaccccaccgaccctgacatacctaccgtgtcaccctgcccagtcctacccgttcctctccatgcaagtgtggccagggcctgggtatcatgtgcacatgcccagcaagagctagctcccctgctcccctcttttcctgtcactatatgacaatcctaattgtgtctgatgatgagtcattccaattactggattaaagaaaaagtgctacggagtcaagggggggggcctcatcgcgttgaacctcgggcatcgggaagacaggggggaacatatagatggaaaggggggggcccttggaatgaaagcggacgaaacccaaggactgagccatggggtcctgtgcccacccggtaaggaaaggaggcgtggggggcaacgacgccgggaaacgatacagaaaggcggcgggcagagagaagaaaaaaagagaaaagggaagaacgggacaaagaggaacgcgctgacaagagaagagca

SEQ ID NO: 701 - DNA, 4850 bp, Homo sapiens
gtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggttacttctagcgcaggcttccttccttcctctagctcctcccggtgccctgggtgctgggtgctggatggatgggcgtcctctagctcctcccggtgccctgggtgctgggtgctggatgggtgggcgtcctctagctcctcccggtgccctgggtgctgggtgctggatgggtgggcgccacggtgcacccttgttgggctgcctgtgcccgagtggcctctgcagctcttatgtctgcctctaatgggatgtgcgccctgactgcctcgttcttaagggcatagtgggtcggctaagatctgatcgccaggactgcgttctgggcaggtgctgggaaggcggaaccaagccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagctctgggcctgtcagtccacctgggtcctctctgggccctgagtgcctggaccctctgtgccaagcaccagcaagcaaaggggatgaccttgggcacccccaaggtgctgagactacagccagtgagcccctgctgggggccaaagccatggagggtgcctgggcccttccaacctggaaggaggaggggagagagcaggcagcagggcagggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggaatgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcaggggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctgggga

SEQ ID NO: 702 - DNA, 563 bp, Homo sapiens
  misc_feature (391)..(391): n is a, c, g, or t
  misc_feature (516)..(516): n is a, c, g, or t
  misc_feature (526)..(526): n is a, c, g, or t
gcgaaaaatatttttaaataaatttttttttcttacattctgatatacatatgtaacaaggtttatggcactgtaaccagaatcaaatcagaaaaaaaaaaaaaaaaggaaaaaggtgggaaggaaagtatttgatatattgttgaattcctttctatctccaagctggcaaatttgcactatttgtctatcattcagctgccagctctaacttgtttgcacacttaaaacatcatattattgcacaagaagccagtgaaggcatataatggtcagttcctcactatttcaaaaaaaatctcttaaacccagagaaggaaaaaaaaaaaaatccagagcatgaaacacacaaaatcaaaggtatcctttttctccttaaagaatgcctganggattcttagaccacttaagctgccctgatcttctctttggcaccagtgagcacaacagggcttggtttgggttgggtttttggttttctgtgtggacagcccaggttgatcccaggccttgggngattcaatgncctttccaattacctttgggtccttttaatgggttaa

SEQ ID NO: 703 - DNA, 982 bp, Homo sapiens
ttagattcatctttttaatgacatcctaaaattcagaggaggggccagcgggacctctgggctcagcggctgtgaaggagggacccgcaacacccgctaaggcaggtaattgcaagaaggcactcgcgagggggacttcaagcccctcttctatttcttcatataaaatcagggggatggggaaagctccaagggcgagggaagcagagagagtttctctcccagcctatggaataaggaagaggtgaggaaggggcgggtgctgggagcaagaaactgccaagtccaggacctgccctcacacagacacacacagcccgcacctgccctccctctaaaatctgcatccggggctgtaaggaagccccgtgttcaagcccccatctcttctcccttctagctggtacgaattggtaatcgccactctgggtgatgtagcgaacccagggcagggcctggtaaccacttttctcaatgatcttcatgtatcggacctggatcccagagacggtgaagtaggggatctcaaacttgaccccgatggggggccggcctccacctcttccttttccacactggggaggccaaagtgggctcgcatcaagtactccttgccccccggaaagacttaaatactcaaatcacgacgtttctctgcggcacatacttggcgctgcccacactggtcttgaatctgggggagtcggcatcgctgggtacaggcacagattatctcacaccgttggccactgactgtttactaaactgccccttgccttgaccatgaatcccacgcggctgtgggagaactttcaatgacagaatcaatccaattagttggcttagctgggtgctggggcggtatgacatgagcccaaattcacctcaggcgggaagaaaggatagggtgcgtcgttatcaagcagaagaacccgacggcctggtggaatttttaatcttcaactcttaatgatttgttttt

SEQ ID NO: 704 - DNA, 2034 bp, Homo sapiens
attccccatgtagccgcgccctctccttcccctgggcgtctccggggcgtggacaggccgctgaaaggaaccggctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaag

SEQ ID NO: 705 - DNA, 2719 bp, Homo sapiens
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 706 - DNA, 2362 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaagcggtggaggttgaggaggttattgaggagtcccgcgcaaagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcc

SEQ ID NO: 707 - DNA, 4147 bp, Homo sapiens
ggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagacgttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcagaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcaaaaaaaaaaaaaa

SEQ ID NO: 708 - DNA, 872 bp, Homo sapiens
gtgtccacatcattgacttaactgcttcgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaccaagaaagtggctttctactttcaaaaatgaaacaaaaaggaaaaatggcaacagtactgttttagctgtgcatgtcatatccacaaagacttttagcaggtgaactgttccaagactgacacaaggatgtttcaaacttggcctctgtctgtagaacacatgttaaaaataccaactcacttggaaggaaaacataacaaatcacaaaggtatattgagcaccaacctctaccccccccccccccaccccccctatccctctgatccacctccactccctgtcctcccgctactaccatcccacccacacacgaggcgcgcccctaatctctccccctgcgccccacacgtccgcaccactgctgacaggccaccgcagctgtcgtgtcccgccggccctcatcccgctccgcattcgtgaatggaccaccgttgcgacagcgacccacgttccccgcaaatacgtgtcacgcctcggcatcatttaagcgcac

SEQ ID NO: 709 - DNA, 1359 bp, Homo sapiens
ggccagggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgcccccgccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttgatatttattttcaaattaaattgaggttacagacaccttcctctccttcctcctctcactaagcttgtttctgtatgtctctagtctttggtttattgacttaaaatccagggccttgtttgtcaaactatctttgtcaaacttctgtcattgagaagccctcaa

SEQ ID NO: 710 - DNA, 525 bp, Homo sapiens
  misc_feature (354)..(354): n is a, c, g, or t
agaacgtagagaaaattttattaaaaaattaaaactatttaaaacctgatatatgaaaataggcaacagtgagaaaaaagcacttttgtgacaaatatttagctggtttgaaagacagaacaaggaggaatcatttactcataaagaaggctcaaataagttaaaacatggatgtatttttaaaatgaccactctagtagtgaattttaaaagtcttttaagggttagagtaatctttttcattagtcttggctatttcctctagttctgacaagtacaggcaagaaaatggcttactctaagtaaggattattctgaaacacggtctggatttagaaaataaatgaacattangggaatttccttaattaagactctccaaaacccagttgtgtgctcattgcctgtatccccacacttttgggaggcaaagaggggggggacccctgggttatggaatcggactagctggccaccatgggaaaaccgttttctaaaaaccaatataatatacaaaatttgctg

SEQ ID NO: 711 - DNA, 979 bp, Homo sapiens
ggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattc

SEQ ID NO: 712 - DNA, 2730 bp, Homo sapiens
ggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttccttgtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgcctcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcagtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctgagggcctggccctcttcctcttcctggagagaacagccctccaccacccacagacctcgcgggcctcacttagcgtgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcgtttattttccaaatgagcagtttagaaatatgtgatgtaaagtacatactgtacgtttgctgaaaattatattaaaagcactattttaattcttaaaaaaaaaaaaaaaaaaaaaaaaa

SEQ ID NO: 713 - DNA, 3240 bp, Homo sapiens
ggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgccaaaaaaaaaaaaaaa

SEQ ID NO: 714 - DNA, 931 bp, Homo sapiens
acgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaatacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctccagcccgcagctccaggagtctgtcttccacctgctggtgcccagtgtcatcctggtcttgctggctgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctcttcgtgggaggagacattatggggcgtccaccaccacccctccctggccatcctcctggaatgtggtctgccctccaccagagctcctgcctgccaggactggaccagagcagccaggctggggcccctccgtctcaacccgcagacccttgactgaatgag

SEQ ID NO: 715 - DNA, 1741 bp, Homo sapiens
gcgggacacagtctcttctcctctgctcttctttgggcagagggtctcaaagtttccgtctgctctgtgcagagggagtggagctccgagggcttgtggcttcgcagttcctcttctgtgaacagccgagatcacgcgctcctccccagccacccgttcctccccgcagtccttcccctccactcccttccccttctctgctcatgcagggagcccagaaagcctccgcctcagagatgctaccgctgctgctgcccctgctgtgggcaggggccctggctcaggagcggagattccagctggaggggccagagtcactgacggtgcaggagggtctgtgcgtcctcgtaccctgcagattgcccactacccttccagcctcgtactatggttatggctactggttcctggaaggggctgatgttccagtggccacaaacgacccagacgaagaagtgcaggaggagacccggggccgattccacctcctctgggatcccagaaggaagaactgctccctgagcatcagagatgcccggaggagggacaatgctgcatacttctttcggttgaagtccaaatggatgaaatacggttatacatcttccaagctctctgtgcgtgtgatggccctgacccacaggcccaacatctccatcccagggaccctggagtctggccatcccagcaatctgacctgctctgtgccctgggtctgtgagcaggggacgccccccatcttctcctggatgtcagctgcccccacctccctgggccccaggaccacccagtcctcggtgctcacaatcaccccacggccccaggaccacagcaccaacctcacctgtcaggtgacgttccctggagccggtgtgaccatggagagaaccatccagctcaatgtctcctatgctccacagaaagtggccatcagcatcttccaaggaaacagcgcagccttcaaaatcctgcaaaacacctcgtccctccctgtcctggagggccaggctctgcggctgctctgtgatgctgacggcaacccccctgcacacctgagctggttccagggcttccccgccctgaacgccacccccatctccaataccggggtcctggagctgcctcaagtagggtctgcagaagaaggagatttcacctgccgtgctcagcatcctctgggctccctgcaaatctctctgagtctctttgtgcattggtcatcagcaccagttccagacaggcatagtttcagaccaccctgctgaggctggccccatctcagaagatgagcaggagctccactacgctgtcctacacttccacaaggtgcaacctcaggaaccaaaggtcaccgacactgagtactcagaaatcaagatacacaagtgaggaattgtccaaagccataaccttgattggagagaacatggtacctctcagtgtattggttactagggctgccacagcaatgtaccacaaaccgagtgacataaacacagaactttattttcgtatagtttcagatgttagaggtctgagaacaaggtgttatcagggttggtcccttctaaggcctctcttgttggcttgtagatggctgtctcctccttgtgtcttcacatggtctttcctctgagtgtgtttgtgtcctaatcttctcttcttataaagacactagtcatattggattagggcctccccatgacctaatttaaataaattaactatttaaagaccctcc

SEQ ID NO: 716 - DNA, 3628 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaaaaaaaaaaaaaaaa

SEQ ID NO: 717 - DNA, 1147 bp, Homo sapiens
atccgcggggcgactcccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaa

SEQ ID NO: 718 - DNA, 439 bp, Homo sapiens
ctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtctt

SEQ ID NO: 719 - DNA, 615 bp, Homo sapiens
gaaaatgatattaattttattgcatcattttactgactagaacgccagacttagagtggatataagtataaaaataaccaaattcttacaaataatactttgctgctacagtactgaataattagtggaggttgcaattataatacaactttaaataacattctcataatgggtttaacacaatcaaccaggggctaaggtttaaaggtttacaaagagaaatccaggacaacatgaaaactcccaaagttcatattccagctaaatgcttcatttaaccgtcaatccaccaacacaaacattaacaaaactcagagcaactcatgatgaaacagtcgttctctttttaggacaggccaaggttaatacagaaaggtaaatgattcggattagtttcccaggcagaactgattccatcccatccctggcctatcccatcctccctacccaagaaatctgtaatgaagtatgttaagtgcattttaaaaatctgaatatgcaaattcttcaaaatgtcctctttgaaaatgcccaggtgacagacccagtctcggacctgtcgctttttagacctgaatggtccccctttggtttcatagggttttctgtgagcag

SEQ ID NO: 720 - DNA, 495 bp, Homo sapiens
tgtgattccatttatttaaagttcataaacaagaaaaacctctgaggtcagaataagggatgccctgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaaccttgcagttgctccggctttttaaatgtttgatggtccttggttttgtgctcattttc

SEQ ID NO: 721 - DNA, 3630 bp, Homo sapiens
cggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcattttttaaaccctttgttctctctcatttgacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaatgtgtggtttttatgatttattaaataatctcttaggaggcatttctgaaaaaaaaaa

SEQ ID NO: 722 - DNA, 1610 bp, Homo sapiens
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 723 - DNA, 2497 bp, Homo sapiens
actggataagcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagaaaaaaaaaaaaaaa

SEQ ID NO: 724 - DNA, 631 bp, Homo sapiens
caagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggcccca

SEQ ID NO: 725 - DNA, 1881 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgaaaaaaaaaaaaaaaaaa

SEQ ID NO: 726 - DNA, 2755 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtaaaaaaaaaaaaaaaaaaaaaaaaaaaaaaaaaaaaaaaaaaaaaaaaaaaaaaaaaaaaaaaaaaa

SEQ ID NO: 727 - DNA, 3290 bp, Homo sapiens
cgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgaaaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaactgagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccagctctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctactggaccgtgagccaattaaacctcttttctttataaaaaaaaaaaaaaaaagg

SEQ ID NO: 728 - DNA, 5059 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatttactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaatagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggtggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggatttt

SEQ ID NO: 729 - DNA, 2997 bp, Homo sapiens
ggactgcggtctcgggcagcaatggccgagaagcgcgacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctgacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccacaggcaagaacctgggctgtaactgccacctgacaccgctgactggctaaatgctttgcagaaagtgatgaccttacaccacaaccagcttctccaggtcatatgtgccttacctccagaagtctttttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctccaaagtgctggattacaggctgagctaccaccctggtttggagagtcttaattaattgaaatttccctaatgttcatttattttctaaatccagccgtgtttcagaataatccttacttgagagtagccattttcttgtgtacttgtcagaactagaggaaatagccaagactaatgaaaaacattactctaacccttaaaagacttttaaattcactactagagtggtcattttaaaaatacatccatgttttaacttattttgagcctttcttttatgagtaaatgattcctccttgttctgtctttcaaaccagctaaatatttgtcacaaaagtgacttttttctcactgttgcctattttcatatatcaggttttaaatagttttaattttttaataaaatttttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgactgggcagatactgtcaacttacaatatctatatagagaggctttaaacttaccttactcattctctatgatgtatgacttgatgctgaaagaggaagctggtcagctcctcatggacaacaaattcttagtctataatattaggagacatctctagttttgcaaatgtctgtgaatctgagcaacctggacttctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtccttccctgtacccaattcaagcttattttagggaagccttgaaactaccatgtatctggctctagctgagttattgaggattgagccagtgcaacgttaaactcagtgcacttacatttgatttaaatgatggttttatctgttgtgtgaagtggttcacccttgaggaccaggagcctccatatcctgactgaaaaccttttctgagacttagagtaacagtacttttggttccttgagttctcctgtctccagatacctaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcact

SEQ ID NO: 730 - DNA, 3963 bp, Homo sapiens
attaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccgaaaaaaaaaaaaaaaaaa

SEQ ID NO: 731 - DNA, 3299 bp, Homo sapiens
acttccccctcccccctcccttcctctctcctcccttttccctcctttccttgtctccttcttcttcctcttctttcccccagcccccctcctccctgtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctggaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcctgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctg

SEQ ID NO: 732 - DNA, 3054 bp, Homo sapiens
agttgagtctgcggagccgcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttgggaaaaaaaaaaaaaaaaaaaaaaaaaaaaaaa

SEQ ID NO: 733 - DNA, 740 bp, Homo sapiens
  misc_feature (97)..(97): n is a, c, g, or t
  misc_feature (115)..(115): n is a, c, g, or t
  misc_feature (123)..(123): n is a, c, g, or t
  misc_feature (125)..(125): n is a, c, g, or t
  misc_feature (135)..(135): n is a, c, g, or t
  misc_feature (171)..(171): n is a, c, g, or t
  misc_feature (186)..(186): n is a, c, g, or t
  misc_feature (258)..(258): n is a, c, g, or t
ttatgcttattggcttatggggccatggcatcccagcgtgtttgggcatgagtaagtgcttcacagcatcaagcacaaggctcaagccagcacagcnacagggcattcatgaagncaaagtananccagaagtanagaggtggccaaagctctccgtgctgaaatccgtcncggtgctctgtcagnaagtagagcacatccccatagatctggcccacagagaccacaagctgtagaatgaagcgaaggggatgctgncgaagaaaggcgatcaccacccacaggctgagtggtccccacaggcaagctgtgatggtttccatgcacactgtgaagttgtcacccaggatgtatcggctgtctcccttggcatactctttccagagttgagataagaaggcttggtctccaagcaggtcttcgtagtagagaacgaaccagccctcgatcaccaggtgaatgaacccacacactgcaaaccagcacagggacagtcgccgccaagtccccaatgggacaaccgcagcacgacctgacaacagccatgtggtcacgactaagacccctgtgacagagaagaggccagccagtatatgccaggtggggcggtcattaggtacaaagttgtccagtcttaggtgctgaggccagtatgggtgcaaggggcccgcgttggtagtcatgtctttgtgggctgatggctgcgtgtgtataggcaggaagttaaaaaaaaaaaaaaa

SEQ ID NO: 734 - DNA, 8032 bp, Homo sapiens
agtgcccgcgcgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaatgacattgttttattactgagaacaactagagaactctgcaagtttcttggcttagactcgatctttattaatacattatctattaggtaggaaagacatttgtcagctattaaggtgacttttatctagcggagattcctctcttaaagtaatgaaaggagataggtatggggggtgttatacaggataattggtgacatctgagtgtcttacttctgcaagcctgctttatggtgagcaaagcatcaccagcaagtgatcacaatgtccactggccgctttttgcctgccgtcctcgagatgaaattggcagttggggctgattcacagaaacaccgatttgtggctgagcacggtggctcacacctgtcatcccagccctttgggaggctgaggtggacagatcacttgaggtcaggagttcgagaccagcctgaccaacgcagcaaaacccatctctactaaaaatacaaaaatcagctgggtgtggtggcacacacctgtggtcccagctcctcaggagtctgaggcagaagaatcgcttgaacccaagaggcagaggttgcagtgagccaaggttgcagtgaatcaagattgctccactgcactccagcctgggcaacagagtaactctccttctcaaataaataaataaataaataagaaacactgatgtgtctgtcaccttctaaagaaatgaaatgctaggaagtcctagccagagtgatcaggcaagaataagccataaaaggcatccaaataggaaaagaagtcaaactgtctctcttcactgccgatatgattctatacctagaaaaccctaaagactctgccaaaaggctcctggaaccgataaatgacttaagtaaagtttcaggatagtaaatccatgtacaaaaatcagcatttccaaacacagtaacattcaagctgagcaccaaatcaagaacgcaatcccatttccaatagccacggaatgaaatacctaggaacacgtataaccaaggaggcaaaggatctctacaaggagaaccataaacgagatgctgagtcccagcgaggtcggaggtgccactgagccctcatcgtggtgccgttcccgctctgggttatttatctgttgctcatctcagctgttgttcctacctcaaatttcaagtccctcaacaaatataacagaaccacttctagaatgaacctttgagaagggaggtagcagtgcattgtataggaattggcattctatagaaaaccacagaaactggaaataatgaagggttgtctcttggttttaaaataatgtatacacctaaatcatccccttatgatactcatcctctaacagcaattgaacttcaatacaatgagtcattcctgagttcactcgcttcacattacatatgtttctctataaccacaagcatcctggcttggtagtgctcccacagcaccaaaaatccctgaggaggctgacaaacattgtgctgactcatgctggagacaagccacagagaacttccatcccccaccacatcagccacggagccagcccagcctctgcccacccaggcctcagtccccagtgttaagttctgatccctgatgctggcctgccagtggccagtcaagattctctttctgaaagctagtattttatgaggactgactgttgctagacattacactaagcacattatatgttgtacttcattttaccctttcaacaatcctattagtagcttactgtgggtctgcaaagccttactcaaaacatatagggctagaggttctcaggattctgaattttaaaaaaaatttgtaaaggcttatggctctcaccactgttattcaacgttgcattaaagtttctacccagagaaggcaataaaaggaaattaaagctatacagattggaagtgaagaaataaaagtctttattctcaagaatacaagacactatgtatagaaattgtaaggaatgcaaaaaaaaaaaaaaaaaaaagccctacaagaacttataacaagtttagcaagattgcaatatacaatcttgcaatcttcctaaagattatatacaaacctaacagaattgtatttatatatactgtcaataagcaattcaaaatgaaattaagaccacgattccatttaaaattgcatctaaaaataaacaaaataggaatagacttggcaacagttgtaacatctgtatactgaaacctgtaaaacattgctgaaagaagttaaagacttctttaaatagagacatatacaaagttcatagattagaagatgcaatattgttaagatgatagtcctcaaattgacgtatagattcaatgcaatccattaaaatctcagatggctttttatagaatttgaaaagctgatgctaaatcttttatgaaaatgcaaagaacctctagtagacaaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaacccaagagagtccagctcaaaaacaacaacaagaacaaaagtatcacattggcataagaatagacatgtaaatcaaataacaaaatagagaattcaggtataaatcttcatatttatggctgattgactttgaacaaaggtgacgaggcaagtcagtatagcagcatattcttttcaacaaatggtgctggcagaagaaaaaaaaagtacttggatccttacctcacaccatgcacaaaaattagctcaacgtggactatatcagggtttctcaacatcagcagtgttggcgtttgctggggtggataattctttcctgtggagagctgtcctgtgcactgtagaatgtttagctgcatcctggcctctgcctattagatgccagtggcatccctcccctgacacacacctagttttgacaatctctgtctccagatattcccaaatgtgccctggagagcaaaactgtttccagttgagaaccattgacctaatgtaaaaaataaaatgtacagaagaaagcatagcaggaaatcattctgacctcaggttaggcaaagctttcttagatatgacactaaaggcataattcattaaaaaaataagttgggctttgtcaaaattttaagttttgctcttctgaagaaaccattaaaaaaaaatgaaaagacaagccacagactatgaaaaaatacttgcaaatcatatatctgataaaggacttgtacccagaccatgtaaagaactcataactcattaataaaaggataaagaaaaagctgaagacaattcatgcaagaagatatacaaatattaagcacattaaaatgctcaatattattagtcactagggaaatacaaattaaaggcccaatgaaatacctattacacacccattagaatgactgtaaacaacaagactgataattccaacatctgaccaagatatggagaaactagaactctcctacattgctggcatgagtgcaaaatgatacagccactttgaaacaccatttggcagttgcttaaaaaattgaacattcaactaccatatgacccagcaatttcactctcaggtatataaccaaaatacatgaaaacatggatctgcacaaggtcttgtatacaaatgttcatagcaacattattcataataaccaaaaattagcccatcaactgaaaagtagataaacaaaatgtatatccacaccatggaacgctactcagcaaacttctaaaaagcaacaaactactaaacacgtgcaacaacatgaatgagcctcagaaacataagtgaaagaggtcagacacaaaagactacaaattgtaagattccatttagataccatttctacaaaccgcaaaactgtagaggcacgaaacagattcatggtctgctgcagctggggatgggagtgggaacagagagcaaacattttgggatgatggaaacattctaaaactggattgtgattttggttacacaactgtatacatttactaaaatcaatgaacagaacacttttaatgggtaagccttaaggcatgtgaattatacaccaataaagctattttttttaaaaaaaagagagagagagaacgagagctacatggcagccccagggcaatagctctcagatctcccttagagaaagaactttctcttccacagcaatgagtgcaggtagctaacactgaccaacctgcatctggtagttcatttaaggtcggccttggctttcaagttaaggccatggtctttctctgcagtccccagccaatacgtgggcacagaaaggcacagggcatggctgattcagcccaacatgaggctccacaccctagaactccctgtggagttggccgatactgcctgtgacctgcaatgtggtctaagctgtcagacctccacagtggccagaaggttttccatacctgagcctgcttctacccacttttatttttcccaggagtcacgcttagtcatctcttgctctttgaactccatgtctgtatcagctacccagaggacccatcagacagaaagtaatatgcagataacagcccaggggaatctgggcagcactgtgaaaccaacatttcttcagtgaaacctagaacaaaagtggaataaataaaaactaactgtctcatttca

SEQ ID NO: 735 - DNA, 607 bp, Homo sapiens
  misc_feature (550)..(550): n is a, c, g, or t
tttctcagtctacctcacttaatgtattaaaaaggaggctttgccccaaccccaccccatgagaagaagcatgagaaatgcgggagcgcaacagagagcttgaagcgggctccaggtgggtctggtggacagaagggccacagtgcctgcctgctgggccatccacttgcccagggatgttctaggctctctgattggtgtggcaacgttcctgaaacgctgtgatccccgtgggctgtgctctgccagtgacagcatctgcgtaggagggctggacgatggtcggtatggctcaaaggagctgggtcccctccggagccccacggcgggggtggcggaggagaggggagcggtagttacgttgcatagtggtcaaagctgccgaggtactccagggccgcacggtagcacagctgatactggtcctctgtctgcaccatggcaggacgctgtgtacgcagggtcttcacggtctgaaacatgtcgaccacgccctcatagcgcatgcgctccaggacgatgctcagagtgatgaacaccccggtgcggnccacgccagcactgcagtgcaccgtgataggcccatcctgtccaaactgctccttgg

SEQ ID NO: 736 - DNA, 3701 bp, Homo sapiens
taggcggtgcatcccgttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaa

SEQ ID NO: 737 - DNA, 397 bp, Homo sapiens
tgtaaaattaattttatttcaaaatgactgagggggtttatataaatagctttcttgatgattcttttggtaaagtcagtacttctttaatagctaagatatcagttgtgaattgaccttgtgggttcattaggaggattaccggctgggcttgctacaggaggcccccctgtagtgaggcatttcctcccagtggctttccaactgtgtcccatgaacctctgctggggtgaagtatgggagaaagggcaggccagtctggccttcctcctcttcctcctttcctcccacccctgactccccacccaaccaactctattggttttcctgccaaaaggcatttacctccctgcattggtgactttgcctcctggggctggactcctgaaaccctgac

SEQ ID NO: 738 - DNA, 1021 bp, Homo sapiens
ctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataaaaaaaaaaaaaaaaaa

SEQ ID NO: 739 - DNA, 1570 bp, Homo sapiens
gcacgcgggggcggggccgcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaagcaa

SEQ ID NO: 740 - DNA, 3066 bp, Homo sapiens
ttccttttatgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaaaaaaaaaaaaaaaaaaaaaaa

SEQ ID NO: 741 - DNA, 507 bp, Homo sapiens
tgaaagtccttattcatttagtaagcgaatatattataatatgtatagagcgccttttgtgtaagtcactggtcagaatcctcactgagctcccagtccagagagaagccagacaattaaaacagtaatgacaatgatgtgtgtggcctttgtctactcaaggtccctttctgctcccctcttctagtctcacttcccaaggctgtgagctctaagccctccctatgtggagagaagtcaccctccccttgctccatgttcagctcaggaacttgcgtggggttgagctggtacctacatatgctgccaagtggctcaccaggggaaatgggttgtgtatgcgggcaggagggtcaggtccttgtcccactagggggctaggtttgggatctccagggtgcagcctggactcctaagggcagattagggctgatgactggatgatgctcgtggtgggcttgtgcctgcccaggtccctgggactcagaggtacccaccctaagttcc

SEQ ID NO: 742 - DNA, 4490 bp, Homo sapiens
cgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacataaaaaaaaaaaaaaaaaaaaaa

SEQ ID NO: 743 - DNA, 532 bp, Homo sapiens
  misc_feature (519)..(519): n is a, c, g, or t
taactatggaaaaccatgtttatttttaataaaggatgacatttccaatcagtaaaatatcataaaagtataaaaatgtactaagtacaatcattagcattatgttataggggaatagtggttataacttttccctgtaagatggcacattggatggtcacagttggcttgatttacagaggggcaagagtaggtgaccagttgtaccagttgctccagtttcctaggatttgggactcttgtaaaatgagaaagtcccaggcaaactgggacggttggtcctacaagaaaaagagcagcatcagagtgttggctatagtttggaacttaggaacaggatcagacattattttttaacttctccacctattttccctttagctgtgaaataaaaatcccttttgttattactgagggtgttacagctttcagaggcttttttaccactgggtttcatgtaattttgacttaatacctatgtcaagcctgggaagaaaggcagttctaatcaacttgcangtgtggcattctg

SEQ ID NO: 744 - DNA, 3636 bp, Homo sapiens
tggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaaaaaaaaaaaaaaaaaaaaaa

SEQ ID NO: 745 - DNA, 2589 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttaaaaaaaaaaaaaaaaa

SEQ ID NO: 746 - DNA, 577 bp, Homo sapiens
ttaagggattcaatgtctgtttattaaggcagatgctcataaaagtgactttcagtaacattttcagtataaaaaatggatttacatttcatttctggaaaaccgttttgtacagtctgaccatggctaggagtcccagggacagcagcctctgctcagggcagactctgtgattcactgtctgtcctgctgctaccccacgtgggggagaacacgtgggctgagaaaaaaaaacagcatgtgcaaacctgacagatgtcaagggtcccaacacagttcctttaagcgaaaataaagcccagttttaagatgtgcagggaagtgttgacactgaacaggcagctgaccaagccctgcagggctctgagcaggcaggcgagtcccaaggagagtcagtgacagcacatggggcaagggagctggacagaagaccccagagggtgcggcacctgtgtgagagccctggactgcacaccaaggcagaggggtgcccctgaaggactctgggcaggcaatgacaggatctgagggtgtccagacgcagatctccactgcctgagggagagtgatcagccag

SEQ ID NO: 747 - DNA, 1574 bp, Homo sapiens
gctccaaaaagtccaagggagtaagcttggaggaaacgctgggttcaacttgaagcccttccacagacattaagtcggtgaaaaccattcactaggagaggagaaacacaatggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagattttttttttcctgtggctcttttcaattatgagatcagttcattattttattcagacttttttttgagagaaatgtaagatgaataaaaattcaaataaaatgataactaagaa

SEQ ID NO: 748 - DNA, 3581 bp, Homo sapiens
gtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttgaaaaaaaaaaaaaaaaa

SEQ ID NO: 749 - DNA, 775 bp, Homo sapiens
acaatggtatagatttcacaacacaaaaaggacattggtggatgttactgcacattttaaattcttaacactaatttatctgtataagtgtttatatgcatattttgggacataaacagtttatgtaaaattagtaatgaatgatggcaacgagggcactgttatcttcgttgttttcaatgatcatttagcattcaatgatggaacagctggtataacataagtggtcggcatgaaatatttgagatcgaaacttctgtgccttgaacagaacttatatcttagattctctctcacattttctgtggagctggggttgaataggaaccagatgatgttcactgctgaaattccataatgcttcccattgaagggaagtgagaaccaggaaagctgctttcacgtcatgtgccatccagtactgacagggaagaaagatgtagttttccagtagtgatgaatcacattatgaattacatttcttcttaagaagtaaaaactcagaatgtaccatctgtgtttcctttcagttcattaaatggcatcataacagatgacttgtgctaagttcaatagagttaccacatcttttactattatgcaaaaatattaactttaatgaaccattgcttggacatgatttcctatacattaccattgggccgaatgtgttggtcatactatcacgcactaaacctgggtgtttacactgggcaccgcgcttcaccgggcataaggcggacaacggtcttaggcaaactcgggtcctcgaaac

SEQ ID NO: 750 - DNA, 1536 bp, Homo sapiens
ttgcaaatcgcggtacctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaaattttcatcttctcaaaaaaaaaaaaaaaaaaaaaaaaa

SEQ ID NO: 751 - DNA, 694 bp, Homo sapiens
gctcttcctccggggccgctggcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgataaaaaaaaaaaaaaaaaaaaaaaaaaaaa

SEQ ID NO: 752 - DNA, 2418 bp, Homo sapiens
gggaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgacgatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaaaaaaaaagatatcactcagcataatga

SEQ ID NO: 753 - DNA, 553 bp, Homo sapiens
gatgcactggctgtacctttattatttttacctcgttcactaacagctccgtgacgcaaggttaccacacacagttagatagtgtctgcattgcacatctaaggctatacagcaaaagaatcagaattagtacaaatacaagaactatatttacagtctgtatactcaagctccaaacatcagataatatttacaaaataaaacatgaaaatgaaaatccaaaattaatgtacattgttgctaatgtgctcaactccttcacgggggagagatcagtttgcaaagtcttggttcaaaaaggccacttatgcattatgggttttgttgtcatgtgtgaggatggtgacaagagacttgaaatctcaacagacaggtactttagagccacaaagtctaagacgatgccttaaatacaagaaggctgagggactcctcaagtgagctgatgccagaataggcagaatgaaaaaaaatgaactcgaagacatgaagaacaacacacaacagccacggtttggcaagagaccaacctcagctcagactttccatctga

SEQ ID NO: 754 - DNA, 1851 bp, Homo sapiens
tgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtaaaaaaaaaaaaaaaaa

SEQ ID NO: 755 - DNA, 5063 bp, Homo sapiens
gccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaaaaaaaaaaaa

SEQ ID NO: 756 - DNA, 3279 bp, Homo sapiens
gacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaaaaaaaaaa

SEQ ID NO: 757 - DNA, 1424 bp, Homo sapiens
gtatattctttttatttttacattgaaatcaccttggcaaatctgacaacatgattatcagaattcagcagagaatgatgtgtcaatcaatcacacatctactttcttgttttttattgttattgttgttgttgttgttggcggtggtggtggtggtggtggtggtggtggtggtggtggtggtggtgtttgagacagagtcctgtgtcatttgagacagagtcctgtgtcatttaggatgaccttgaatgtgtgactcactcatcctgcacctcccaaatgctaggatggcaggtaggcacaatcatgcctagcttcatagggtgcttagggctgagctagggccttgtgcttgttctgcaaacactccgccaactgaaccacatcctcaaccccataaggacattatggagaagagaacctgccacagaacaagatgctgctggttttctggtgccagatgaagaaaaggaatgggcggtcacgacagaaccttggctctattctgcagctccgggtattcctgatcactgcagtggtcgcagctgcttcggtgccttcctcattaacctccacaaagcacttgtgggcaaccttggacacaggcacattcttcttacttgtcatcccagagaagtcagcctttgtttcctcaaaggcatctgtcattcccaaactctgaagaacagtttccaggtcataactttcctccagctttaatctggggaaaaagacttgcactttactttctgtcagggtttctgggtttgtccaagctctaagcttctcatatgtaagtgctttctccaccacagtgagatcagagctctcatcaggaaggagaacgaccatgctcagctcgtcctcagcatagggcagagccagaacctgcgcgttcacctcatccacatgtgccatcttaaatttagcatgcttgaacatcatctggactgtcttcttctcctcctggttagttttaaagggcatgcccctcgtgtacttcctgtcaaactgagccttccacttccctttgaaatacatggcattaacaagaaccagcttagtcagtgggcaaactgttccaggactcagaacttcggaaattttaccttcagttttttccaacacccagtcattgatgcgtttcctgcacccttcagtgtctttaacaaaggacatctcttctatcccagcctggtagaacttctggcaggattccttgaaggtcgaaaggaaatcacatgattcctctccactggagcccccagctttgtaatcatgtgatcagtctgaatcattgtttctgtcacctgacttttcagctagtgtctggagccctctgaactccagcgtaatctctagggtgcccacaccatcaagactccccccagtggtttacttgcaaaaataaaagctgcagaagc

SEQ ID NO: 758 - DNA, 1447 bp, Homo sapiens
gcacacgccttggcgcttctcgaaagagatttcctcccacgcgaccttccagttctcggagccaggttaggggtttggcggaggaggactgcggggcgcgggcctagggccccagcagccacggccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtggacccttttttggagggatcttcaggctgaagacgcccacccagcactctccagtccccccggaagactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctgaaaaaaaaaaaaaaaaaaaaaaaaaa

SEQ ID NO: 759 - DNA, 1730 bp, Homo sapiens
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaa

SEQ ID NO: 760 - DNA, 2644 bp, Homo sapiens
atggccgaccgggaaggcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcactctggaaaaaaaaaaaaaaaaaa

SEQ ID NO: 761 - DNA, 3769 bp, Homo sapiens
gctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaaaaaaaaaaaaaaaa

SEQ ID NO: 762 - DNA, 4071 bp, Homo sapiens
atgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccatgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcccccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 763 - DNA, 14121 bp, Homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgacgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagaccctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 764 - DNA, 490 bp, Homo sapiens
ttttttttaccaataaagtgatttgtatataactggcggcagggggaggggggcggttggagactgaattgcccattcaaatcattagactttttaaaaaaacatttcctcgatggaaatttccagttccacaaaagaaagtaatcaaacagatgttcctccttaagtcttaaaccacgacattcagatgatctatgtgcaaattaataaggttatgacataattcaattatgtgacaaagccgagggagagttgacaaagaaccagactggcatcattgacttctcaatgaagtggagctcggtaaaaaatctagatgaatcacaggttgtctgaccagaagatccctgacaatgggctgtttactttagagaaaggagctgaaccctgaaaactgaatgtgcgaaattctaattatcaaaaaacccacggcgcatcaggtagacatgatcatctgcatttcttttccacgctgcaaatcaccgcgatc

SEQ ID NO: 765 - DNA, 630 bp, Homo sapiens
  misc_feature (544)..(544): n is a, c, g, or t
  misc_feature (580)..(580): n is a, c, g, or t
attctgccactccagtttattgaaatgagtaaatttatagctttatttgcatacagaaaagtgcatgagaaaataagtatgtacaaaacagttgtgtggctgatcatgactttcaaaaattcaactacctagaaatagttacctccagtttagcacatttaggtatttggacatttaaagtactatttcaagtctgtgtttatagtgactgagtaggaagctgatagaaaattatgccatatatgatcaactattaccattaaacataaaaccacaggactttctacttggggctaatcaatagagggtcatgtggcccctgtcttgtttagcttctgagcatcaccctcttcttccccctcaaggtaacgttggatgtggctgattaactcccacaagaacctgagcattaagggtcaagagacaacattaaaaacccaacataaacaaaacaaaacaaaacttattttgaccataataaacccttcagaactgtgctcacaacaggactggaaatgaactgggaacgtttccaagttgtgangagaaaatattgcagacattagatttccatgggtanccccaacattggtctacagccttttctccccctcgtgccgaatcctggcc

SEQ ID NO: 766 - DNA, 538 bp, Homo sapiens
  misc_feature (443)..(443): n is a, c, g, or t
ttttttacacagtgtacaactctgaactgagaaagtgcaaggagaccacgggaatggaagtgggtaggggtcgggaggatgggcaccaggctggtgtcctgacagccacacctgggtgcaggccacgtgtcctcacggccaaggtaaccgggtgtctcaggcacttaataaatattaagggtgaccggtgactcaggctctgcctctgggaagtggcatcatttggtgaatgagtttggtctcggtgccaccacggattcagccagatcattttcgacgccatgaatccctttcctggcttaaggaaggtacaaacccacctcgaaagacactgggtgggtcatgattcgggggtgacagggcaaaggctaacctggctgtctagcaaggcttgcatagaagaggtaaacacgttgactcctgagtttaggggtttggcttanagattggtggatgaggcagggccagggggtcccgttggtgccatctgctgttgtgtgttgaaagccacttgcttctctgggcctgacatcccctg

SEQ ID NO: 767 - DNA, 4618 bp, Homo sapiens
gccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaaaaaaaaaaaaaaaaa

SEQ ID NO: 768 - DNA, 465 bp, Homo sapiens
tttttttttgctgaaacatgcagagaatttttatttatcacgaatgttaatacttatattgacttgcagaacagagtgagagagacgtgcaggccaaggtattagtagggttcaagggtttagcaggacatctagtacacagtaggttgctcactaaggacttgtcatatcttgctcaaatgccaacttttggtacagcagattgtcaattagtcatttcttatagagatgcctttttggatagttgtcatactacatttctgccaattaaggatttcagtccatttttcgttttttcaatcatcgtttaaggtcaggtagcaggggccccatcccccctcccccctcagataacagaatagtattcttattagaagttcctaagaccgagcaattccagcatgcaaattgtgataggacatagccgggaagatgagaaactgtagccatcatctagggatatta

SEQ ID NO: 769 - DNA, 5958 bp, Homo sapiens
  misc_feature (49)..(49): n is a, c, g, or t
cagccgccggcgagcgcgccgagacgccgaacaggtggccggagcgtgncgggcgccgcggcggggcgaggcgaggcaagccccgggcgaacgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcgcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccatgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcattggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcgccaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgacttggcgatgccacgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 770 - DNA, 4619 bp, Homo sapiens
aggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtcttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattgaaaaaa

SEQ ID NO: 771 - DNA, 5679 bp, Homo sapiens
gcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgtaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 772 - DNA, 2837 bp, Homo sapiens
tgaaaagatccttacggcttctgttgtttcatagcttctgcttacagtgttctgggtatccttcagttttgctaccaccctatagcctctcagtgtgcctcacatttagatacctccagagagaatccgattggattcttcagccattatctaatataggggtgcatggcaaccagtgcataaggaaccacttgtggctacttactcagaggagacttcagatctaggagacagtcagagtaccatgtccagaatatataccatgatgaattagcaagatgcagttttcaatacatagatgcaaagtgattatggtatgagaattttttaatctcagattttgtaatttgcttttacaaagcacccatttgacagcaccttgtttaaagaccacaaaaagcatgtccttaaaactatagtcacattcttggtgctcccttcactttgtttggggtattaatactactctgaggctgccatgggaccacctgttccaaaaatattctttgatgtggattgagtagtttttactgtgattattctaccaagataaacatagaatttattgcctttcacagtaataataagaaaacattgttaaagaaggtttcggccaggcacggtggctcacgcctgtaatcccagcactttgggaggccgccgagccaggcagatcacaaggtcaggagtttgagaccagcctgaccaacgtggtgaaatcccatctctactaaaaatacaaaaattagccgggcatggtagcacacacctgtaatcccagctactcaggaggctgaggcaggagaatcacttgaaccggggaggtggaggttgcagtgagctcacatcacgccactgtactccagcctaggtgacagagcgagactctgtctcaaaaaaaaaaaaaaaaaaaaactttctttggttgactaacaatttttcattgttctaatgggtgtcttcctccttcacaagggaggaagatcctccaaagtatctgtgagtataatcttataactggtgtttttgttaagaaataattaggagtcaccaggcactccattttttaagttcacaaatttcaaactttttttttaaagatttacttcctcattttaatagggacagaaggataaaaagtatatttctgccatcttagggggatggaagttttggtaactctctctcctttgaaggtcctggaatcgtttattataatatataccatttagtatacatgttgggctgtctgaatgagaacatacccatcagtgtgcacatgtgcttacaaacatgttcattcatttagtgaaattaagagtggaagcaggctgttttcagaaaaaatatttgagggctgagttccctctttcattcatcccatgagggtattactagggggtttaatatatttgggttaatgatgagggggaaaaaatagcatccttttggggaaatagaaccagacacaatttaaagtgggacccaaatagaaacataattcttttatgaaacaaatgttttattttctgtttgtcacacggatgccatctaaattttaaaagaaatctaggcttcctcttattctttatgttttttttaaaagcaagaagtcagagactttgtacatcatgattaacttctacatttgtttgagctatgtgtcacaagtaattaagttataaatattctgaagattaattggtgcacactctaagtgctttttaaattttacacagcttacctttctttctgaagaatgtcctcacaaagatagattatatcaatttctccactgatgatgtattccagcaataaacatagtcctagaattgtagaatgtgcactgctgcactctgtcctaacagacagtagacaaggtttataatttttttctatgggacactaaaaataccctaggatttcctttaactttttgcactgacaggtctaaagcaaagccacagaagctgctcttgctcagtaagtattgttaatgctgcagtgcatattaaaatttcagaaaacccaattatgtactatctaggtgtggatagctctcattgttagtatcctaaatcatctaaaggcttgttttctttcttttttttttttttacagacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttattttttaaaaaaaaaaaaaaaaaaaaaaaaaaaaaag

SEQ ID NO: 773 - DNA, 5265 bp, Homo sapiens
acatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaa

SEQ ID NO: 774 - DNA, 1201 bp, Homo sapiens
tcacacaccaaacatacaccacacgccccccaggatgcatgcttatgcattactggaggcgttatggccagactgtcccctctggggaaggtattaaacaaaaagaccaataagtatctcctctcgccatttccccctaccctccccaacaattgcacagcaatgtctgaacacatctggttgacaacgaacaatttgtaaagtggtctagcaactacattatgaactgtcccatcacaagacatacagttggcctttcttgctgagtcagatatttttacgtacactacacgaattttcttggacacagtcaaagacaagcagaatagatttttcacaagtaacgggcaccaaagctcacatgctggcaatttgtaaggcaaacgaggttgttctgccaccaagtggctggagctaaagcaggcttcgacgcacgttggcagcagagggcccaagcaggccccctatactggaccctactggtttctgaggccactgaacgcctcacagaggcctactctgggttgttaaactcagccagcagagaccaaccttagaaaacaggaattgcccaggtgccaattctcaggttctcaaggagaacacatggggctgattacttgtaccgcccacgagacccgtggaagacacaattggctcttcacaagcttacttgcacaatccaccatgaggtgcctcaaactcaacatagacgagtcccatcaatgcacactgcaagaagggcacatgacaactgctccgagacgagcactcagcatcatgcccctgaatccagacaggttaagcgacgctggccttcataatcccagaggacaccgaaaattccagtgcctgcaaatcgtaccgcacaaggtaggaagcaccacacctactccatggaatcacacggctcacccggcacaccctcggccctaattaccaatgtcacactcagccccaacgaaacaacccatacatacaacacgagctccaaccacagctcaccgtctgcccctcgcacactgcgccccaatcgccactacacagaacctccaataacaccccctaccccctgcttccaaatcgcgataccattgccacacacctaagagcgcaaacgacccacagagagaaacctccaaccccaaccaaaccaaacccgcaaaccccacacaactcaacagaccagacaaacagacac

SEQ ID NO: 775 - DNA, 2240 bp, Homo sapiens
gtatttgtttcactgctttcaaccgcctgtgctggaggctcagaataagtcaatgggaggaggatttcagtcacagcagcaagcaagtctagtgaacagataagatgacatgctcagcaaaataacaacgaaaccagagggggaactctctggcatgcaagttcaaacacgactctacaactacggcagaaaaagagagagagagaaactaaaaatatatatatatcctatttttttcacagctatcagtttctttcactgagctttcctaaatttaagcctctagaaaataataaatacttggatatcttacctacaaacatggacagatgtgtgtatgcgctcattttagagaacttgaatttttttttttaaaggaaggtgtcaactttggcttttgagtgtttggcatggttacaatgccttaaaaaaacagatgagcagcttagctactaaccatgctgaccactgttcggaacgggattgaatcacagaaaaacagcaaatggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatagcagaactggcagttgtcatcaaacataatgatgagtaagatgatgaatgagatgtaaatgtgccaagaatatattatataaagaattttatgtcatatatcaaatcatctctttaacctaagatgtaagtattaagaatatctaattttcctaatttggacaagattattccatgaggaaaataattttatatagctacaaatgaaaacaatccagcactctggttaaattttaaggtattcgaatgaaataaagtcaaatcaataaatttcaggctttaaaaaaaaaa

SEQ ID NO: 776 - DNA, 2238 bp, Homo sapiens
gccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagc

SEQ ID NO: 777 - DNA, 6860 bp, Homo sapiens
gccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaaaaaaaa

SEQ ID NO: 778 - DNA, 832 bp, Homo sapiens
ggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaaaaaaaaaaaaaaaaaaaaaaaaaaaaaaaaaaaaccaaaaaaaaaaaaaaaaaaaaaaaaaaaa

SEQ ID NO: 779 - DNA, 1879 bp, Homo sapiens
tggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggacgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtactttggtgggggattcgtggatctttagattaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 780 - DNA, 2880 bp, Homo sapiens
gcgcgcgcgacgcaggtgcccgagccccggcccgcgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaagcaactttccactgttgctttcggagtgagcaagatagaaactgctccttatgtgcagacaacattgaaggaaggacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccggtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttaggaaatgcttgtgaagctacgtcctacctcgtgcgcacctgctctccctgaggtgtgcacaatg

SEQ ID NO: 781 - DNA, 2208 bp, Homo sapiens
gggtcatataatgcaagtgactatggactaagagttagttatggtgtcttatgactagatttattatggtatattaaagtaacaataatattaatattaccttccttttttttttgtttcaaaagagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccgggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagccgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaaaaaaaaaaaa

SEQ ID NO: 782 - DNA, 8018 bp, Homo sapiens
cgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggccgtcttggaaaacagactgatcaaggttcaatgcagataccttccagagatgatagcacttcattgactgccaaagaggatgtcagcatacccagatccacattaggagatttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgagttggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggagcagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaaaatgtgtataaagaaataaatagtttttctttc

SEQ ID NO: 783 - DNA, 7176 bp, Homo sapiens
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagcggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagaggtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgcgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttc

SEQ ID NO: 784 - DNA, 1930 bp, Homo sapiens
gcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaa

SEQ ID NO: 785 - DNA, 1914 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaactcttcagacactgagggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtgagaagtacaactgagaaatcccttttgaaggaaggttaatgtaacccaacaagagcacattttatcatagcagagacatctgtatgcattcctgtcattacc

SEQ ID NO: 786 - DNA, 3185 bp, Homo sapiens
ggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaaaaaaaaaaaaaaa

SEQ ID NO: 787 - DNA, 1735 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 788 - DNA, 6147 bp, Homo sapiens
atgctgcgagtgattgtggaatctgccagcaatatccctaaaacgaaatttggcaagccggatcctattgtttctgtcatttttaaggatgagaaaaagaaaacaaagaaagttgataatgaattgaaycctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacacgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacgctctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtmggccagtgcaccatcgagcgcctggatcgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacacgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcggggattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaa

SEQ ID NO: 789 - DNA, 4913 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaaaaaaaaaaaaaaaaaaaaaaaaaaaa

SEQ ID NO: 790 - DNA, 1650 bp, Homo sapiens
tccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggtccaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatc

SEQ ID NO: 791 - DNA, 1973 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattgggatgtgtactgggagtaagatttgaggttgtaagcaaactaagttagtgtaatttggcttcatatatgtaacgtgaggtattaatgtaattcatatattaaagcaaaaattgttcgcagc

SEQ ID NO: 792 - DNA, 5691 bp, Homo sapiens
ccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaaaaaaaagaaaaagaaaaagaaaagaaaagaaaaggtacatcagacatgactgcctgcatgaagtcaaacagggtaacaccagtgaagctcaagtcaagagctgtggatattttgtctaaccaacaagaagtctcaagaaatcaggcagtgcagctgcctgctctcagctatcgtatccagccaaaagatgcatgatgatggagtggtgggggaaggccagttcagtatcctatttaaaagtaaacttcctgaataatggatatatgtggagatacagacatagatatatagatacagctgtaattatttagcctcaagtgactttctccattgcttcacgctatgccactattttgcttctttaatttttttaaccttgcttagtattctatagtttgcccaaccagttttacgtccaaggaaaattagccaatgcataaaatatacaaactatgaaaggcaaggatcaggaaaccagagactttgccaccaaatctcagattattagaaactaggtgtcagggtttatcaagaaggccaggaaggccttttgggttaagccttacattcatgaagaacctcaagggtagatttttgagagcattccaaatgaatggtctctggtcaaatgaatgaatggtcaaatgaataaatctgccctcacagagatacaaaaggaaaaggaatataattcataccatttggtttaagccttacattcatgaagtacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataaggtagtttggaataaagaaagaaaagatcactctacatacagatagtaaacttaatttgtgatcctatatatgagacagtataaaaatacagataagttttagaaagactcaaaacaatatgtaaatgactgatgtttgcattattaaggaagacttgggatgttgggtcaagaggggaaagtgttagtcaatccactttggagcaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagatttttaaaaataaa

SEQ ID NO: 793 - DNA, 8833 bp, Homo sapiens
agctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgactgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaactgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggc

SEQ ID NO: 794 - DNA, 1564 bp, Homo sapiens
gaagcacatctggacagctgtgcggcctccttgcgggccgacgtcagccgagcacgtcccccacgtcctctccttctcgccacttattatttattcgttttcccaaagaagcgactagggacccaagtttaaaaattcctccccccactcaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgc

SEQ ID NO: 795 - DNA, 572 bp, Homo sapiens
  misc_feature (419)..(419): n is a, c, g, or t
  misc_feature (433)..(433): n is a, c, g, or t
  misc_feature (512)..(512): n is a, c, g, or t
  misc_feature (520)..(521): n is a, c, g, or t
  misc_feature (531)..(531): n is a, c, g, or t
  misc_feature (558)..(558): n is a, c, g, or t
  misc_feature (560)..(560): n is a, c, g, or t
aatttatcacgtgcttaaaaatcttcaaaatagcttagtgaggctcatgacagtgctggccccatggaaatgtagtcttttgttgcgtttaaacactgtcacaccatctatgactgtcccattggtctgaagtgtagtggcaaactaagcatcctataagacaagctaaagcttgctttttgccagtcagttgaaagtcttgcatctcttcactgatgcactttctttaggtattgatagtcagaagcacaaagcatttattatgcattcaatcatgtagctaaacaaaaaactgaagtctcctgaagccatttaaaccagccgttccaaaatctcctgcgaccactttgttagtaccgcaaaaactttcccactataaatgaaggaataaatggtagtgctgctctccagaatcctanggcactggttccgnattttggaccattggatttaactaataactggggcaaaagcctcaaaaaaccctgaaataaatttccagctttactggnaccagccnnaagtaaaaancttaatttgcctggtaactggatggcngnaaaatttaaatt

SEQ ID NO: 796 - DNA, 3151 bp, Homo sapiens
aaaaaaaaaagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcatttgttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagtcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaggtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccgcagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgatgaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaacaaaaaaaaaaaaaa

SEQ ID NO: 797 - DNA, 3924 bp, Homo sapiens
atggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaaaaaaaaa

SEQ ID NO: 798 - DNA, 3705 bp, Homo sapiens
gatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacactttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgaaaaaaaaaaaaaaaaaaaaaaa

SEQ ID NO: 799 - DNA, 2445 bp, Homo sapiens
cgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 800 - DNA, 1365 bp, Homo sapiens
gtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttccaaaaaaaaaaaaaaaaaaaaaaaaaaaaaaaa

SEQ ID NO: 801 - DNA, 993 bp, Homo sapiens
gggcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtacaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctacaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactaccc

SEQ ID NO: 802 - DNA, 5820 bp, Homo sapiens
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttataaaaaaaaaaaaaaaaaaaaaaaaaaaaaaa

SEQ ID NO: 803 - DNA, 3595 bp, Homo sapiens
tttggaaacgtcacactgtggaggaaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttcaaaaaaaaaaaaaaaa

SEQ ID NO: 804 - DNA, 4973 bp, Homo sapiens
cagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagaattggtgtgcttatgtacataccaggttatctcccacagtgatattggacaaccaggtcacttatgtcccaggtgggaaaggaccttgtggctggaccggtggatcctgtcctcagagatctcagaagatatccaatcctgtctataggatgcaacataaaattgtcacctcattggattggaggtgctgtcctggatacagtgggccgaaatgtcaactaagagcccaggaacagcaaagtttgatacacaccaaccaggctgaaagtcatacagctgttggcagaggagtagctgagcagcagcagcagcaaggctgtggtgacccagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctgaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaaaaaa

SEQ ID NO: 805 - DNA, 681 bp, Homo sapiens
ggctggcgcggggaatccaggccgacccgggcggaccgaccccaggcggcgacggaatcagtccccaatgcctggaaattcctcatggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgatttgtgaatgatgtgagtgagaaggagcaaagatggggtgccaagacggtgcagggctccgggcaccaggagcatatcaagtaagaggcgtcgccaccaccctcccgagggcccctctgcggatggagccccaggtgcaacagggcccatggtcatctgtggagggacagcccgtgtggaaactgcatttatcttcttgacctgatacccatgcagtaaatgaatataagacacacacatatatgagcaagagcaaacaaaaaacaaaaaaaacttcgagagggcaattttattttcgaggggtgcggaaaaaaaaagggtataggaaagtgggcactttgtgcattaggtttgttccctggccccaggttttttgggaaacaaggggtgaattttggcgggttccctttaggaggaagggaattaattcataaggcagttacccggattatag

SEQ ID NO: 806 - DNA, 328 bp, Homo sapiens; identical to SEQ ID NO: 678

SEQ ID NO: 807 - DNA, 1637 bp, Homo sapiens; identical to SEQ ID NO: 699
  misc_feature (1315)..(1315): n is a, c, g, or t
  misc_feature (1498)..(1499): n is a, c, g, or t

SEQ ID NO: 808 - DNA, 1216 bp, Homo sapiens; identical to SEQ ID NO: 679

SEQ ID NO: 809 - DNA, 1462 bp, Homo sapiens; identical to SEQ ID NO: 683

SEQ ID NO: 810 - DNA, 2774 bp, Homo sapiens; identical to SEQ ID NO: 692

SEQ ID NO: 811 - DNA, 3004 bp, Homo sapiens; identical to SEQ ID NO: 671

SEQ ID NO: 812 - DNA, 583 bp, Homo sapiens; identical to SEQ ID NO: 672

SEQ ID NO: 813 - DNA, 444 bp, Homo sapiens; identical to SEQ ID NO: 698
  misc_feature (307)..(307): n is a, c, g, or t
  misc_feature (320)..(320): n is a, c, g, or t

SEQ ID NO: 814 - DNA, 332 bp, Homo sapiens; identical to SEQ ID NO: 688

SEQ ID NO: 815 - DNA, 609 bp, Homo sapiens; identical to SEQ ID NO: 684

SEQ ID NO: 816 - DNA, 483 bp, Homo sapiens; identical to SEQ ID NO: 676

SEQ ID NO: 817 - DNA, 461 bp, Homo sapiens; identical to SEQ ID NO: 691

SEQ ID NO: 818 - DNA, 2088 bp, Homo sapiens; identical to SEQ ID NO: 685

SEQ ID NO: 819 - DNA, 2487 bp, Homo sapiens; identical to SEQ ID NO: 682

SEQ ID NO: 820 - DNA, 716 bp, Homo sapiens; identical to SEQ ID NO: 695
  misc_feature (461)..(461): n is a, c, g, or t

SEQ ID NO: 821 - DNA, 808 bp, Homo sapiens; identical to SEQ ID NO: 686

SEQ ID NO: 822 - DNA, 925 bp, Homo sapiens; identical to SEQ ID NO: 700

SEQ ID NO: 823 - DNA, 1160 bp, Homo sapiens; identical to SEQ ID NO: 680

SEQ ID NO: 824 - DNA, 384 bp, Homo sapiens; identical to SEQ ID NO: 689
  misc_feature (335)..(335): n is a, c, g, or t

SEQ ID NO: 825 - DNA, 1369 bp, Homo sapiens; identical to SEQ ID NO: 674

SEQ ID NO: 826 - DNA, 5810 bp, Homo sapiens
aacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacc

SEQ ID NO: 827 - DNA, 3595 bp, Homo sapiens; identical to SEQ ID NO: 803

SEQ ID NO: 828 - DNA, 2851 bp, Homo sapiens
agccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccagaaaaaaaaaaaaaaaa

SEQ ID NO: 829 - DNA, 2473 bp, Homo sapiens
atcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaaaaaaaaaaaaaaa

SEQ ID NO: 830 - DNA, 8833 bp, Homo sapiens; identical to SEQ ID NO: 793

SEQ ID NO: 831 - DNA, 7635 bp, Homo sapiens
ggggccggggggcggagccttgcgggctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 832 - DNA, 1240 bp, Homo sapiens
cacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaacaaaaaaaaaaaaaaaaaaaaaaaaaaaaaa

SEQ ID NO: 833 - DNA, 2225 bp, Homo sapiens
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagccaaaaaaaaaaaaaaaaaaaaaa

SEQ ID NO: 834 - DNA, 2787 bp, Homo sapiens; identical to SEQ ID NO: 422

SEQ ID NO: 835 - DNA, 6091 bp, Homo sapiens; identical to SEQ ID NO: 447

SEQ ID NO: 836 - DNA, 1348 bp, Homo sapiens
ccagatttggctttatatagcggacccgtaaggccgaccggcctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgacaaaaaaaaaaa

SEQ ID NO: 837 - DNA, 972 bp, Homo sapiens; identical to SEQ ID NO: 634

SEQ ID NO: 838 - DNA, 1110 bp, Homo sapiens
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgaaaaaaaaaaaaaaaaaaaaaaaaa

SEQ ID NO: 839 - DNA, 2099 bp, Homo sapiens
gcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtaaaaaaaaaaaaaaa

SEQ ID NO: 840 - DNA, 511 bp, Homo sapiens
ggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaa

SEQ ID NO: 841 - DNA, 4605 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 842 - DNA, 4745 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaaaaaaaaaaaaa

SEQ ID NO: 843 - DNA, 7274 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 844 - DNA, 7730 bp, Homo sapiens
gtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaa

SEQ ID NO: 845 - DNA, 1759 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaaaaaaaaaaaaaaa

SEQ ID NO: 846 - DNA, 829 bp, Homo sapiens; identical to SEQ ID NO: 635

SEQ ID NO: 847 - DNA, 401 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaaaaaaaaaaaaaaaaaaaaa

SEQ ID NO: 848 - DNA, 7732 bp, Homo sapiens; identical to SEQ ID NO: 441

SEQ ID NO: 849 - DNA, 1021 bp, Homo sapiens
tgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacaaaaaaaaaaaaa

SEQ ID NO: 850 - DNA, 5777 bp, Homo sapiens; identical to SEQ ID NO: 697

SEQ ID NO: 851 - DNA, 1320 bp, Homo sapiens; identical to SEQ ID NO: 539

SEQ ID NO: 852 - DNA, 4041 bp, Homo sapiens; identical to SEQ ID NO: 613

SEQ ID NO: 853 - DNA, 2090 bp, Homo sapiens; identical to SEQ ID NO: 558

SEQ ID NO: 854 - DNA, 4406 bp, Homo sapiens; identical to SEQ ID NO: 588

SEQ ID NO: 855 - DNA, 1406 bp, Homo sapiens
ctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 856 - DNA, 2168 bp, Homo sapiens
ctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaaaaaaaaaaaaaaaaaaaaaaaaaaaaaaaaaaaaaaaaaaaaaaaaaaaaaaaaaaaaaaa

SEQ ID NO: 857 - DNA, 1245 bp, Homo sapiens
cgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 858 - DNA, 1730 bp, Homo sapiens; identical to SEQ ID NO: 759

SEQ ID NO: 859 - DNA, 3163 bp, Homo sapiens; identical to SEQ ID NO: 630

SEQ ID NO: 860 - DNA, 1610 bp, Homo sapiens; identical to SEQ ID NO: 722

SEQ ID NO: 861 - DNA, 5161 bp, Homo sapiens
cgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaaaaaaaaaaaaaaaaaaaaaaaaaaaaaaaaaaa

SEQ ID NO: 862 - DNA, 4258 bp, Homo sapiens
aggggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaag

SEQ ID NO: 863 - DNA, 2377 bp, Homo sapiens; identical to SEQ ID NO: 540

SEQ ID NO: 864 - DNA, 1202 bp, Homo sapiens
gagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgaaaaaaaaaaaaaaaaaaa

SEQ ID NO: 865 - DNA, 4087 bp, Homo sapiens; identical to SEQ ID NO: 420

SEQ ID NO: 866 - DNA, 1507 bp, Homo sapiens; identical to SEQ ID NO: 535

SEQ ID NO: 867 - DNA, 1096 bp, Homo sapiens
gactcgactggtgtttgatcacgatgggagaatcatccagaaaaccccctacccccaccccagagggacccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaacttacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttatctctttcagctctgaaacatcacacatctaagattcgagagtttgccgacctaactcgggttgaaacttttggctttcaggggaaagctctgagctcactttgtgcactgagtgatgtcaccatttctacctgccacgtatcggcgaaggttgggactcgactggtgtttgatcacgatgggaaaatcatcaagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgcagagagggacaagataag

SEQ ID NO: 868 - DNA, 1035 bp, Homo sapiens
gcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataaaaaaaaaaaaaaaaaaa

SEQ ID NO: 869 - DNA, 3240 bp, Homo sapiens; identical to SEQ ID NO: 713

SEQ ID NO: 870 - DNA, 5423 bp, Homo sapiens; identical to SEQ ID NO: 575

SEQ ID NO: 871 - DNA, 9737 bp, Homo sapiens
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataattgtgatttgttgagccacgtctatattaactatagctcccctctatttttaaaattttacataagaattgcttcttcctcttttgtcaagtccacagagacaatgtgaagcattattgaatttagactgtgttgcttcatagtctggataacaggagccactttccttcctcagaatttaggacataaacccaattttaggtctgcattatgtaagcctgtttgcattgtcatttttattttagtgcaaaagactaccaatatgagtgaattatttgtttgtaaattggcataattgtcttcataatttaatgttcagaaatgcagtaaagcacgttgatgaaaagcttagtctctgtggaagacagaccagaagacaaatcccttttctatctactgtggcatattcactgcaaggtaaaggacatgtatgcatacatgcaagaatgaattgagcgaaactttgaatatgtttcctcttttgagctattgttatttagtagttacctaaaaaagaatacatttttactagtataccattaaaaatgtaaaaggcttaacatgtatgcatacatgtagacacacatacacacacacaaagttaaacaaagctcattactgtgcaactatgaaagctgaactcatatgacctggtatggcaaaaatttgtaaccagtgttggagaatcacaaatgtgttatgcactatccattacatgttgatataagacaaccgagctcactggttgccgcacataatacccatagcagcacaagatgcaagtcttacccccaaatgcttacccggaatgagcagaattgtcttactcatcctgattttacccaaaatctcatgaatgggcttgctgttgagcgtggtcacacaaggtatagtttgtacaagtaaagaaatgtgaattagtagctatttatttccttagtagcaggtaggactacttagcttgttacaacagctttgatacacagtaagaaaactctactgacagattacaagcagccaaatgtgtttacatttcagagaagggtaagggaagcctctcgttgtcttcatactttggaatgtcttaagctaaaatgtgacactagagttcaatttcttttttattttaaatgtcactaaattgtaggtaaactgtaccaaaaagttctagtttaattttaacagtaaaaactcagcataccatgttaccacgtaaacaataatggctggtattttctgtgggttaatttaacatgacataaacataggaaagcccttggcaaaattctacatcattgaagtagaccatttctaaatgcaattaaatagtgaggttattataaaaattagaatttaaaatatgacttgttgatagtgcagattataatgttacttagaaagttaagaattcgagagtaatgatgctattggagaactggtttgctatacggcagcaaaaacataatgagaatgtaccatgaagaaattgtgttaaatattcactttgagtgaaactttaaatatgtttcctcttttgagctactgttatttagcagttacctaaaaaagaatacatttttactagtctaccattaaaaatataaaaggcttaacaaaaacgcatataaaagttaataaaatgttactcagattagtactttaattgttaaaatgtaattaatgagctccatagagcccatacatcacagttccattgaaaatatcatctggactagaatctcttaaacccaggaagtggaggttgcagtgagccaagatggtgccactgcactccagcctgggtgacagggcaagaccctgtctcaaaaaaaaaaaaaagaaaagaaaaagaaagaaaatattatgtggaaatttttcatctttttatgatgcctgggatagatttatgcagtagatttatatataatgtttagtttacaaacttgtgaaactatttcatgtgggttctgaaaggcaaaacagaaatggccagtgctggtgatgtttgattagaccagctcttctcagctggggtgattcattatccctctctggtgacatttggcaatgtctggagaccagagacattttttattttcatgactcaagggtgctaatagcatgtacttagtagaggttagggatcctgctaaagatcttacaatgcacaagtcagcctctcacagcaaaataattatccaggctgagatgtcagtagtatcaaggttgacatctcagacctggattagacctggattagaccaaaatgaaattttgattgttccaccttgtcttcacttaaagatagatatacatgctcacagcattcaaaatatgactacaatttaatgaaaatattttcttatggtagattacaactcactagatacaccatacatatgccttttggacataattggttagataggagtgtgtgtgtgtgtgtgtgtgtgtgtgtgtgtgtgtgtgtgtgtgtagcatgaagttaggcatctctatccttaactgtgctatgtgttcctaagtaaggacctcgctagaatcatcctgtagagtgctctggaatactctattattaagatcttcaattctaagctcccattatctttctttgtttatctgaaattaagaccttcagaattaggcctggtacttttccagatttgatcagttacattttgatataactgactcttaaaattcagcttagaagacattcaataagaaaatctttaatcacttttggtgatgcacctgccaagagggggcatcactttgtaccatcagactaattaaaaaaattgttgtgtagtcataaaaattaggctgatccataggggcaaaaggaagggtgaagagactaaaaactagtaccctgatagaattttagtttttattagcctcgatttgagaactgcattgattccaaagatcatgaaggtaggtgaaggattaagtcattccataattaagaaaagtaatgtttatatgaaagatttttatatggacaatgactcacagacacatatgctttgtatagaggattttgccaaaagtttatacaaaattgcacatctaaactgcataattctcatacaagaagttaaggaagtgctcactggattttgcttctgtatagttcacttttatctgtcttcacaagggtaggaagtaaatgatctcaaatggcacatgttcagacaatactgtgtttggctttgtgatgtctcatgtctttctcttggctaaaaaaaattgtttaggctatatataacttgtacctgaagcaatctggacaacatggcttaaaatggaaaataactgaaaaaatcctgggattttaaatttgccaaaaatacccttggattagtcaaaggctttacaagagtgttatagatgatccaaaatggaaacaatattgataacatttcttttcgtcagcagctacatattccagttttataactttattatatacattttttgattattaatagaaagtcagccatccagagttttaacttctgtggttgaaatattgactttgtgaaatttttcactgacaaatacttgttaggagggacctaagggggaggggaatgttaccagtccactgaaaactttaggaaatgttcattgtgttgtgtaaatactttcccaccagcaccaggtaatatattctctatgtttgtagaattccaaagatcaaaagctgtaaggacgtttatgtgaacttgacgcaaacttgtggaggaataaggactgagagtaatgttgtgctttttctttatcttcccgtcgtataggtcgactctcaggttatatgacttttattgggcacacgtcaggggtggaagtggtagaagtgggttaacaatttcaaggcctggcaacctaggtcaaaacctctaataaagtcagcagtaaacataactagcaacttcattccactatgtgctaggaggagggtgaggcaagttgaaaggagatgaccctatccccacactctcaggatgtaaaagggcagagtgctctctacccttaaccttggctttttagcaccgtcagtctctgtcctctcccaggagagctgccttggctccagagttgagctagtagcattgtgactagagaggtagtgtggaaattcgctgaggacctcaaaattttacactgccttaaactgttttgtttttgcttaaactcgtgctgtctaaatgtgggtgttttgtggcagagtctgatcaccccgacctagttatagccctgccagtgattctaaagtggaacttttccccctcattcatatggatagtctgagtccttgaagctagggagatatcaaatattctaccagttcctacatagcttctttaaaagtcctagagactaactcacaggaagtctgaagcccagagcgtctgtttataaactcctaaatatgaggccacaatatttaggttgagcactagaaaatttctattttgcaagtggaaggagacttgaatctataattgctgtagctttttttcccttctatcataagaaaatggataccatctgctttaccctcagcccagacttgtcttttgaattttttacatacatcttaggggtgagagattgaaacaagtgcatgaatgaaaagcttattgaaacataacacagcccctgctcaccatttcagtaagggaaaatacatgtttctgtttccctctaatttgttttctctggtgccaacatttctgatttcttctgtctctaatacataaggaataaataccatattttaaattgacttacatgcctgcgagcatttgccagataatcaaagcctatgactctaactttttaaagcacagaagaggaattatattttatggtcactcctctgtgtttctattgatctctatattgtgctaaaattctttcaggtaatttttttcttgttgaagctgtgggatataatcaatgatgccaagctgtctgagaattttatagaataatatccaaatatattgatcctgcctctttctgcttctatgtaattaaactttcttttgatgtttatttttaaaatgtatgcttcacacaacaccaataaacatctaagagatgtgatataatccaaggcaaagaaaagtaagaatcagttaatgtctattttatctgcacagcattacgaacagaaaattgtaataaaaaaaggtttaaccaaactgaaaaaaagagagacaaaatcttggttttaatttgaaaagatgattgggagtgatctcagaagagagttcagcaggaagcaaggaagaggctgttgaccttgagtgcagcctcaagaatggaacctttttgaaatattttaaaggaaatatcttgtcatccagctgttatggttaataatgaatagttttctctgggtgaagcttatccattgcacacctgatgtgctggcccctgcgatttccccaaatgttggaatgttgcctgcataatttgtggtaatgggggactgtgttcctgcttttacctggttacaaaaaacaaaacaaaacaaaacaaaacaacaaacagaaaaaaaaagagagaaaagatgctagaggaagcagtgtgacagacagatcatgagatgctgacggagagaacagagtggtacctgtttacccacttggaccatgacagtatcaaggctccaccccttgctgtcccttcccaagaggtgctctcctgggagtttgatcacagtgaaacaacactcccgttttctttttcctttctttctttctttcttttttttttttttttttttttttgttgagacagagttttttgctcttgttgcccaggctggagtgcaatggcgtgatctcggctcaccgcaacctccgcctcccaggttcaagcgattctcgtgcctcagcctctggagtagctgggattacaggcatgcgccaccacacccggctaattttgtacttttagtagagatggggtttctccatattggtcaggctggtcccgaactcctgacctcaggtgatctgcccgcctcagcctcccaaagtgctgggattacaggcataagccaccgagcccagccccacactcctgttttcatagcccttttttgtctgtactttggtacatattccccaaataagattattatttacatctgtcatgatgaggcagtgatagcagcaagtgtcactttgaccctcacccttggaaagtgggctatgcatagctagagttagaacaggaggttctaatcctgcttccacaattacttcagtaacaggcttttgtatccatgattacttaagctgacttagatgcattttctaccctgtattctagtgtacacaacacaaacacacataagccctttacctgtggagaagagggagatggttgattcagtgggagtggggagtggcagagggtgccttaactttttctggcttgacccctacttccttatgtgtttccttcatatacctctgtcactttagagatgtaatcatgtctgttccaagttgtatcgttattatcaagaagtcctataaatgtagcaaatgtgactattttatagaaatgcacaatagtttataggccttggagaagtctgataatagtatgtaaatatccttcattgaagtcatagaaccttctagtaggaagctccataggtgataactgcaagaggattaatgtttgtttctccagtaaacaccggaagcaaggaatcaatctgtcactgtttatcattcagtcttgagcaccgttgggtgttgataggttactatagacactccccttataattaatatacaggactcacaatttaggatgtctgatggccactagggtacatcatagagacactagagagaagagaacaaatatagctccatcaaaaagcctgcttaatctttaacaagtctgaaatattactaaaattccagttaccgtgcagcatagtcagtctaaaaagcactggggaaaaaggtgtctttttggtctctttaattctattatggcacattttaatattattccacatgtgtgcaaactatttctcaagagcaaagtttgaggctggagttaagaaaatagaaaaattaaaacattattttttctcatataatataatctgactactagttcatggatataataattctgggaaaaattttagattaaactataaaattgaaatcacctttgaagagtatatggaattgcttctttctattaaagccaacctacattggcaaaaagtgtggagaaaatcagtgtgctcaattctttttgtagagtttcatctaaaatgttgcaggtaaaaaagaaaactttaattggtactttctacggtgtgattagaaaaattagtatctatctctgttggttctgctgacttgcttctttccaccgaatctaaatgcaatgtcataggaggaggtttgctgtaaaaacatgtctttttctttggtgtattcattgtaattatggctggcagtgagaaggttcggtaagtctcaatttctctacctcctttacttggagaaaatttgtaaatgtaccctgtgaataaaatgattttttataaaaaaaaaaaaaaaaaaaaaaaa

SEQ ID NO: 872 - DNA, 10238 bp, Homo sapiens; identical to SEQ ID NO: 445

SEQ ID NO: 873 - DNA, 4629 bp, Homo sapiens; identical to SEQ ID NO: 464

SEQ ID NO: 874 - DNA, 5820 bp, Homo sapiens; identical to SEQ ID NO: 802

SEQ ID NO: 875 - DNA, 2914 bp, Homo sapiens; identical to SEQ ID NO: 456

SEQ ID NO: 876 - DNA, 2801 bp, Homo sapiens
gctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctcaaaaaaaaaaaaa

SEQ ID NO: 877 - DNA, 5052 bp, Homo sapiens
atgggagacgtaaaagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcaaaaaaaaaaaaaaaaaa

SEQ ID NO: 878 - DNA, 733 bp, Homo sapiens; identical to SEQ ID NO: 659

SEQ ID NO: 879 - DNA, 1949 bp, Homo sapiens; identical to SEQ ID NO: 627

SEQ ID NO: 880 - DNA, 4885 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 881 - DNA, 5360 bp, Homo sapiens; identical to SEQ ID NO: 454

SEQ ID NO: 882 - DNA, 2445 bp, Homo sapiens; identical to SEQ ID NO: 799

SEQ ID NO: 883 - DNA, 1402 bp, Homo sapiens
gagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaaaaaaaaaaaaaaaaaaaa

SEQ ID NO: 884 - DNA, 6275 bp, Homo sapiens
gctgccgcggcggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggcaaaaaaaaaaaaaa

SEQ ID NO: 885 - DNA, 5034 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 886 - DNA, 1365 bp, Homo sapiens; identical to SEQ ID NO: 800

SEQ ID NO: 887 - DNA, 1404 bp, Homo sapiens
gagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgaaaaaaaaaaaaaaaaaaaa

SEQ ID NO: 888 - DNA, 1548 bp, Homo sapiens; identical to SEQ ID NO: 502

SEQ ID NO: 889 - DNA, 3963 bp, Homo sapiens; identical to SEQ ID NO: 730

SEQ ID NO: 890 - DNA, 4369 bp, Homo sapiens; identical to SEQ ID NO: 515

SEQ ID NO: 891 - DNA, 1817 bp, Homo sapiens; identical to SEQ ID NO: 694

SEQ ID NO: 892 - DNA, 688 bp, Homo sapiens; identical to SEQ ID NO: 687

SEQ ID NO: 893 - DNA, 2808 bp, Homo sapiens; identical to SEQ ID NO: 494

SEQ ID NO: 894 - DNA, 4445 bp, Homo sapiens
gtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatcctaaaaaaaaaaaaaaa

SEQ ID NO: 895 - DNA, 793 bp, Homo sapiens; identical to SEQ ID NO: 657

SEQ ID NO: 896 - DNA, 2279 bp, Homo sapiens
aggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgaaaaaaaaaaaaaaaaaaaaaa

SEQ ID NO: 897 - DNA, 1340 bp, Homo sapiens; identical to SEQ ID NO: 667

SEQ ID NO: 898 - DNA, 629 bp, Homo sapiens; identical to SEQ ID NO: 586

SEQ ID NO: 899 - DNA, 6296 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 900 - DNA, 1612 bp, Homo sapiens; identical to SEQ ID NO: 528

SEQ ID NO: 901 - DNA, 3953 bp, Homo sapiens; identical to SEQ ID NO: 529

SEQ ID NO: 902 - DNA, 10932 bp, Homo sapiens; identical to SEQ ID NO: 532

SEQ ID NO: 903 - DNA, 1639 bp, Homo sapiens; identical to SEQ ID NO: 549

SEQ ID NO: 904 - DNA, 2740 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaaaaaaaaaaaa

SEQ ID NO: 905 - DNA, 4447 bp, Homo sapiens; identical to SEQ ID NO: 522

SEQ ID NO: 906 - DNA, 1536 bp, Homo sapiens; identical to SEQ ID NO: 750

SEQ ID NO: 907 - DNA, 5242 bp, Homo sapiens; identical to SEQ ID NO: 457

SEQ ID NO: 908 - DNA, 1329 bp, Homo sapiens
ggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtctatcagccacagtctctgcatgtttccaagagcaacaggaaatgaacacattgcaggggccagtgtcattcaaagatgtggctgtggatttcacccaggaggagtggcggcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagaacctgctaaggccatcaaacctattgatcggaagtcagtccatcagatttgctctgggccagtggtactgagtctaagcactgcagtgaaggagttagtagaaaacagtctggatgctggtgccactaatattgatctaaagcttaaggactatggagtggatctcattgaagtttcagacaatggatgtggggtagaagaagaaaactttgaaggcttaacgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagtcaattaaacctcttttcttcataaattaaaaaa

SEQ ID NO: 909 - DNA, 3109 bp, Homo sapiens
agcctgagaatagttagcaaacaagggaggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaatactgacattaattaaatagagttgtaataaaaaaaaaaaaaaaaaaaaaaaaaa

SEQ ID NO: 910 - DNA, 1756 bp, Homo sapiens
ggcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatctaaaaaa

SEQ ID NO: 911 - DNA, 2759 bp, Homo sapiens; identical to SEQ ID NO: 506

SEQ ID NO: 912 - DNA, 2274 bp, Homo sapiens
gcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaaaaaaaaaaaaaaaaa

SEQ ID NO: 913 - DNA, 3701 bp, Homo sapiens; identical to SEQ ID NO: 736

SEQ ID NO: 914 - DNA, 423 bp, Homo sapiens; identical to SEQ ID NO: 664

SEQ ID NO: 915 - DNA, 2694 bp, Homo sapiens; identical to SEQ ID NO: 675

SEQ ID NO: 916 - DNA, 2821 bp, Homo sapiens
cgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 917 - DNA, 2497 bp, Homo sapiens; identical to SEQ ID NO: 723

SEQ ID NO: 918 - DNA, 8270 bp, Homo sapiens
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 919 - DNA, 3807 bp, Homo sapiens
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactacta

SEQ ID NO: 920 - DNA, 1012 bp, Homo sapiens; identical to SEQ ID NO: 655

SEQ ID NO: 921 - DNA, 2034 bp, Homo sapiens; identical to SEQ ID NO: 704

SEQ ID NO: 922 - DNA, 5362 bp, Homo sapiens; identical to SEQ ID NO: 459

SEQ ID NO: 923 - DNA, 6668 bp, Homo sapiens; identical to SEQ ID NO: 486

SEQ ID NO: 924 - DNA, 1203 bp, Homo sapiens
agaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaacacaaaaaaaaaaaaaaaaaaaaaaaaaaaaaaa

SEQ ID NO: 925 - DNA, 4168 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgcaaaaaaaaaa

SEQ ID NO: 926 - DNA, 1191 bp, Homo sapiens
ccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaaaaaaaaaaaaaaaaaaaaaaaaaaaaaaaaaaaa

SEQ ID NO: 927 - DNA, 1574 bp, Homo sapiens; identical to SEQ ID NO: 747

SEQ ID NO: 928 - DNA, 694 bp, Homo sapiens; identical to SEQ ID NO: 751

SEQ ID NO: 929 - DNA, 2208 bp, Homo sapiens; identical to SEQ ID NO: 696

SEQ ID NO: 930 - DNA, 6850 bp, Homo sapiens; identical to SEQ ID NO: 534

SEQ ID NO: 931 - DNA, 1305 bp, Homo sapiens; identical to SEQ ID NO: 641

SEQ ID NO: 932 - DNA, 2291 bp, Homo sapiens
ccatgggttccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgttacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggcaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctacgagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaactttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcttgaatcacaaataaaagccaattgtatctgt

SEQ ID NO: 933 - DNA, 2115 bp, Homo sapiens; identical to SEQ ID NO: 600

SEQ ID NO: 934 - DNA, 1075 bp, Homo sapiens; identical to SEQ ID NO: 656

SEQ ID NO: 935 - DNA, 3840 bp, Homo sapiens
aggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccattta

SEQ ID NO: 936 - DNA, 855 bp, Homo sapiens
gcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaat

SEQ ID NO: 937 - DNA, 1911 bp, Homo sapiens
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaaaaaaaaaaaaaaaaaaaaaaaa

SEQ ID NO: 938 - DNA, 2789 bp, Homo sapiens
aggaagcggaggaaggtgaagtaggaccgaattcctgtgccgaagaggcctgcagtgggagagcaggatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggg

SEQ ID NO: 939 - DNA, 1869 bp, Homo sapiens; identical to SEQ ID NO: 430

SEQ ID NO: 940 - DNA, 4973 bp, Homo sapiens; identical to SEQ ID NO: 804

SEQ ID NO: 941 - DNA, 5063 bp, Homo sapiens; identical to SEQ ID NO: 755

SEQ ID NO: 942 - DNA, 2414 bp, Homo sapiens; identical to SEQ ID NO: 462

SEQ ID NO: 943 - DNA, 5220 bp, Homo sapiens
ggtctgcagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgtaaaaaaaaaaaaaaaaaa

SEQ ID NO: 944 - DNA, 3570 bp, Homo sapiens
agttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaagga

SEQ ID NO: 945 - DNA, 2149 bp, Homo sapiens; identical to SEQ ID NO: 591

SEQ ID NO: 946 - DNA, 2411 bp, Homo sapiens; identical to SEQ ID NO: 510

SEQ ID NO: 947 - DNA, 1235 bp, Homo sapiens; identical to SEQ ID NO: 478

SEQ ID NO: 948 - DNA, 5751 bp, Homo sapiens
aactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgccaaaaaaaaaaaaaaaaaaaaa

SEQ ID NO: 949 - DNA, 4815 bp, Homo sapiens
tgcgcaggcgcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 950 - DNA, 5171 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaaaaaaaaaaaaaaaaaaaaaaaaaaaaaaaaaaaaaaaaaaaaaaaaaaaaaaaaaaaaa

SEQ ID NO: 951 - DNA, 2982 bp, Homo sapiens; identical to SEQ ID NO: 651

SEQ ID NO: 952 - DNA, 5167 bp, Homo sapiens
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaaggtatggggaaaactgcccccataaagcaattgtctccacctggccctgccctttgcatgtggagattattacaattcaaggtgaaatttgggtggagacacaaccaaaccatatcagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatatataaaaaatagaatattattcagccttgtaaaaagaaatcctgttatgttgggaacaagccccccaaaatctggccataaactcaccccaaaactggccataaacaaaatctctgcagcactgtgacatgttagtgatggccataacacccacgctggaaggttgtgggtttatgggaatgagggcaaggaacacctggcctgcccagggtggaaaaccacttaaaggcgttcttaagctacaaacaatagcatgagcgatctgtgccttaaggacatgttcctgctgcagttaactagcccaatctattcctttaattcggcccatcccttcatttcccataagggatacttttagttaatttaatatctatagaaacaatgctaatgactggcttgctgttaataaatacatgggtaaatctctgttctgggctctcagctctgaaggctgtgagacccctgatttcccacttcacacctctatatttctgtgtgtgtgtctttagttcctctggcgctgctgggttaggatctacccgactgagctggtctcagcactgttatttgaaacaatgtaaataaacctatagggtttattatatatactaagtgaaataagccagacacagaaaaaaaatgttgcatgatctcacttatagtgaaacttaaaaaaaaaacccaaatacatagaaatagagtagaatggtggttaccagagatgaggaaaatacagagacacaggtcaaaagatacagagttgcagttacaaagggtgagtatgtctagatatctaacatacagtatgaggactataatagtattgcactgtgtactgaaaacttgatgacagattttagatattcttaccacacagacaaaaagaaatgtaagtatgtgagatgaagcttatgttaattagattaagtgtatgtacataaaaacatcacattatacacatcaaatatatacaataaaaaagcacattgggagatacatgataaatttctatctgcagttgctatttgcatttttaaaggatatttttattttttaaatttttagctgacaactgtataattatggaatacaatgtgatgttctgatatatgtgtacactatggaatgattaaatcaaactaacatttcatcatctcacatacttatcattttctgtggtgagaacatttgaaatttattctcttgacaattttgaaagatccaatacactattattaactatagtcactatgctgtgcaatagatctcaaaagcttattcctcttaactgaaacctactaccctgtgacatgtggggaacatctctctattccccagccccagtccctaaatgttgaatacacaatggggaaaaaatagtcttcaatgaatggtggtgggaaaattgtatatccacatgcagaagaataaaattggacccttacctcctaccatatataaaaaccaactgaaaatcgattaaagacttaaactgtaaaactactaaaagaaaatatagggagaaagcttcacaacgttggtctgggcaataatttttggatttgacctcaaaagtagatgcaaccacagtgaaaataaacaaatgaaattgcataaaataaaaaatgtttctgcacagcaaaggaaataattaatggagtaaagagacaacttacagattgggagaatatatttccaaactattgttggggctcagaaacggataccctaacatatagtgatttgacaggtggaactaaagaagactcgaggtctctctgacctcctcctcaacctctgtttcttaatcctctgttttcccagagcacaggaggaagttctctgaagttcctttatctgctttaagttcagactcaccaaataagaaaacagttaattctggtgccttccatgggttttcattaactgaagtcatattgtaggaaaaagaatgaagtctcttaacccacctggatagatttttctcacaaaccattgtcttctctgcaagcccagtagactttgtcccaggccatttatgtgatcttcaccccattaagttctccccaaattatttactcttcccccaaaatcacccacacttccccatctccctctcccctaaggacaagggtatatcaccatctataccccattgcttggtggggtgatcactctgattctctgcatgcatttttatagatttgtttgccatttatcctattaatctgcattctgtcaattgtggcaagttatcagcatattttttaacttttaattattcttaatggaaagacacttctgtatacactggaaatctcaggaaatttcttttttccttaagcttaattgaaatgtttacttttcagtaaaatttcaagcttgagtaatgtt

SEQ ID NO: 953 - DNA, 3687 bp, Homo sapiens; identical to SEQ ID NO: 550

SEQ ID NO: 954 - DNA, 2589 bp, Homo sapiens; identical to SEQ ID NO: 745

SEQ ID NO: 955 - DNA, 8934 bp, Homo sapiens
agtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagac

SEQ ID NO: 956 - DNA, 2425 bp, Homo sapiens
attccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 957 - DNA, 1505 bp, Homo sapiens; identical to SEQ ID NO: 649

SEQ ID NO: 958 - DNA, 9580 bp, Homo sapiens; identical to SEQ ID NO: 448

SEQ ID NO: 959 - DNA, 4850 bp, Homo sapiens; identical to SEQ ID NO: 701

SEQ ID NO: 960 - DNA, 4361 bp, Homo sapiens; identical to SEQ ID NO: 693

SEQ ID NO: 961 - DNA, 2740 bp, Homo sapiens
ctgaggaaacagctgattgatcagcctggctcaggcttggggcggggattggctgattggcagcaacgccacgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggacaaaaaaa

SEQ ID NO: 962 - DNA, 5167 bp, Homo sapiens; identical to SEQ ID NO: 547

SEQ ID NO: 963 - DNA, 5345 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaaaaaaa

SEQ ID NO: 964 - DNA, 5932 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagacaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcatgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcaaccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggttttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacggtcttgctctgtcacccaggctggagtgcagtggcatgatcttggctcgctgcagcctcgacttcctgggctcaagtgatccacctcagcctcccatgtggctggaaccgcaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctagtcccagcactttgggaggctgcagatggcggatcacaaggccaggagttcgagaccagcctggccaacatgatgaaaccctgtctctaccaaaaatacaaaaattagctgggtgtgatggtgggtgcctgtggtctcagctactcaggaggctgaggcaggagaattgtttgagccccagaggcggaggttgcagtgagccaagatcgtgccattgcactccagcctgggcaacagggcaagattccgtctcaaaaacaaacactattagaaaatgctctggaggtggcggggagttgttgatttgtgaggacagattgaaagcaactcccagggtggccttgtccacctccccatcgagaatatggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcttctccatgcccaagtcagtttccagccgctggtcttcatggcattcccagcacagctggacaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatcggcttctttacattgatacttagagatttgcagctctctaactttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgg

SEQ ID NO: 965 - DNA, 2940 bp, Homo sapiens
gcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtaaaaaaaaaaaaa

SEQ ID NO: 966 - DNA, 1104 bp, Homo sapiens; identical to SEQ ID NO: 610

SEQ ID NO: 967 - DNA, 11347 bp, Homo sapiens; identical to SEQ ID NO: 545

SEQ ID NO: 968 - DNA, 10585 bp, Homo sapiens
ctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaa

SEQ ID NO: 969 - DNA, 5382 bp, Homo sapiens
gcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttac

SEQ ID NO: 970 - DNA, 4530 bp, Homo sapiens
ctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagtt

SEQ ID NO: 971 - DNA, 6419 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaca

SEQ ID NO: 972 - DNA, 6463 bp, Homo sapiens
ctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaaggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcagtgttttctgtgc

SEQ ID NO: 973 - DNA, 7544 bp, Homo sapiens
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccattaaaaaaaaaaaaaaaaaa

(The sequence listing continues in the following parts.)

What is claimed is:

1. A composition comprising a probeset for classifying a disease course in a subject diagnosed with multiple sclerosis comprising a plurality of oligonucleotides and no more than 50 oligonucleotides, wherein said plurality of oligonucleotides comprise oligonucleotides that specifically recognize RRN3, POLR1D and LRPPRC; and a biological sample of a subject diagnosed with multiple sclerosis.

2. The composition of claim 1, wherein said biological sample comprises a blood sample.

3. The composition of claim 1, wherein said plurality of oligonucleotides comprises no more than 25 oligonucleotides.

4. The composition of claim 1, wherein said classifying a disease course comprises distinguishing between benign multiple sclerosis (BMS) and relapsing-remitting multiple sclerosis (RRMS).

* * * * *